United States Patent 12,508,308 (INFLUENZA mRNA VACCINES) - sequence listing, part 45

SEQ ID NO: 174632 - RNA, 1410 nt, Artificial Sequence
  derived and/or modified sequence opt4 from neuraminidase__InfluenzaA__AFH00497
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucaagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174633 - RNA, 1410 nt, Artificial Sequence
  derived and/or modified sequence opt4 from neuraminidase__InfluenzaA__AFH00508
augaaccccaaccagaagaucaucaccaucggcagcgugagccugaccaucgccaccaucugcuuccugaugcagaucgccauccuggugaucaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucagagugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174634 - RNA, 1410 nt, Artificial Sequence
  derived and/or modified sequence opt4 from neuraminidase__InfluenzaA__AFH00519
augaaccccaaccagaagaucaucaccaucggcagcgugagccugaccaucgccaccaugugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174635 - RNA, 1410 nt, Artificial Sequence; identical to SEQ ID NO: 167093
  derived and/or modified sequence opt4 from neuraminidase__InfluenzaA__AFH00530

SEQ ID NO: 174636 - RNA, 1410 nt, Artificial Sequence; identical to SEQ ID NO: 167093
  derived and/or modified sequence opt4 from neuraminidase__InfluenzaA__AFH00541

SEQ ID NO: 174637 - RNA, 1410 nt, Artificial Sequence
  derived and/or modified sequence opt4 from neuraminidase__InfluenzaA__AFH00552
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcacccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174638 - RNA, 1410 nt, Artificial Sequence
  derived and/or modified sequence opt4 from neuraminidase__InfluenzaA__AFH00563
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174639 - RNA, 1410 nt, Artificial Sequence
  derived and/or modified sequence opt4 from neuraminidase__InfluenzaA__AFH00574
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaagaucaucgagagaaacaucaccgagaucguguaccugaacaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174640 - RNA, 1410 nt, Artificial Sequence
  derived and/or modified sequence opt4 from neuraminidase__InfluenzaA__AFH00585
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucaagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaaggugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucaaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaggccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174641 - RNA, 1410 nt, Artificial Sequence; identical to SEQ ID NO: 167228
  derived and/or modified sequence opt4 from neuraminidase__InfluenzaA__AFH00596

SEQ ID NO: 174642 - RNA, 1410 nt, Artificial Sequence
  derived and/or modified sequence opt4 from neuraminidase__InfluenzaA__AFH00607
augaaccccaaccagaagaucaucaccaucggcuucguguucuucaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaccaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174643 - RNA, 1410 nt, Artificial Sequence; identical to SEQ ID NO: 168449
  derived and/or modified sequence opt4 from neuraminidase__InfluenzaA__AFH00618

SEQ ID NO: 174644 - RNA, 1410 nt, Artificial Sequence
  derived and/or modified sequence opt4 from neuraminidase__InfluenzaA__AFH00629
augaaccccaaccagaagaucaucaccaucggcagcgugagccugaccaucgccaccaucugcuuccugaugcagaucaccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaagggcaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaucagcacccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174645 - RNA, 1410 nt, Artificial Sequence; identical to SEQ ID NO: 166847
  derived and/or modified sequence opt4 from neuraminidase__InfluenzaA__AFH00640

SEQ ID NO: 174646 - RNA, 1410 nt, Artificial Sequence; identical to SEQ ID NO: 168976
  derived and/or modified sequence opt4 from neuraminidase__InfluenzaA__AFH00651

SEQ ID NO: 174647 - RNA, 1410 nt, Artificial Sequence; identical to SEQ ID NO: 166847
  derived and/or modified sequence opt4 from neuraminidase__InfluenzaA__AFH00662

SEQ ID NO: 174648 - RNA, 1410 nt, Artificial Sequence
  derived and/or modified sequence opt4 from neuraminidase__InfluenzaA__AFH00673
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaccugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgugaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174649 - RNA, 1410 nt, Artificial Sequence
  derived and/or modified sequence opt4 from neuraminidase__InfluenzaA__AFH00684
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagagagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174650 - RNA, 1410 nt, Artificial Sequence
  derived and/or modified sequence opt4 from neuraminidase__InfluenzaA__AFH00695
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagagagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174651 - RNA, 1410 nt, Artificial Sequence
  derived and/or modified sequence opt4 from neuraminidase__InfluenzaA__AFH00706
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagcaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174652 - RNA, 1410 nt, Artificial Sequence
  derived and/or modified sequence opt4 from neuraminidase__InfluenzaA__AFH00728
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugcuguggaccagcaacagcaucgugguguucugcggcaccagcggcaccuacggcaccggcagcuggcccgacggcgccgacaucaaccugaugcccaucuga

SEQ ID NO: 174653 - RNA, 1410 nt, Artificial Sequence
  derived and/or modified sequence opt4 from neuraminidase__InfluenzaA__AFH00739
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaggccaggagaccagagugugguggaccagcaacagcaucgugguguucugcggcaccagcggcaccuacggcaccggcagcuggcccgacggcgccgacaucaaccugaugcccaucuga

SEQ ID NO: 174654 - RNA, 1410 nt, Artificial Sequence
  derived and/or modified sequence opt4 from neuraminidase__InfluenzaA__AFH00750
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccuacaccaagauccuguucaucaaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggagagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 174655 - RNA, 1410 nt, Artificial Sequence
  derived and/or modified sequence opt4 from neuraminidase__InfluenzaA__AFH00761
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcgacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 174656 - RNA, 1410 nt, Artificial Sequence
  derived and/or modified sequence opt4 from neuraminidase__InfluenzaA__AFH00783
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggcagaggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174657 - RNA, 1410 nt, Artificial Sequence
  derived and/or modified sequence opt4 from neuraminidase__InfluenzaA__AFH00794
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacuggccgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcgagagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcgacgacguguggaugggcagaaccaucagcgagaagcugagaagcggcuacgagaccuucaaggugaucgagggcuggagcaagcccaacagcaagcugcagaccaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174658 - RNA, 1410 nt, Artificial Sequence; identical to SEQ ID NO: 168008
  derived and/or modified sequence opt4 from neuraminidase__InfluenzaA__AFH00805

SEQ ID NO: 174659 - RNA, 1410 nt, Artificial Sequence; identical to SEQ ID NO: 172038
  derived and/or modified sequence opt4 from neuraminidase__InfluenzaA__AFH00816

SEQ ID NO: 174660 - RNA, 1410 nt, Artificial Sequence
  derived and/or modified sequence opt4 from neuraminidase__InfluenzaA__AFH00827
augaaccccaaccagaagaucaucaccaucggcagcgugagccugaccaucagcaccaccugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugccccuguga

SEQ ID NO: 174661 - RNA, 1410 nt, Artificial Sequence; identical to SEQ ID NO: 168449
  derived and/or modified sequence opt4 from neuraminidase__InfluenzaA__AFH01410

SEQ ID NO: 174662 - RNA, 1410 nt, Artificial Sequence
  derived and/or modified sequence opt4 from neuraminidase__InfluenzaA__AFH34942
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaagaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174663 - RNA, 1410 nt, Artificial Sequence
  derived and/or modified sequence opt4 from neuraminidase__InfluenzaA__AFH34956
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 174664 - RNA, 1410 nt, Artificial Sequence
  derived and/or modified sequence opt4 from neuraminidase__InfluenzaA__AFH34963
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 174665 - RNA, 1410 nt, Artificial Sequence
  derived and/or modified sequence opt4 from neuraminidase__InfluenzaA__AFH34970
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcuguacgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 174666 - RNA, 1410 nt, Artificial Sequence
  derived and/or modified sequence opt4 from neuraminidase__InfluenzaA__AFH34977
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174667 - RNA, 1410 nt, Artificial Sequence
  derived and/or modified sequence opt4 from neuraminidase__InfluenzaA__AFH74468
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcagaaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgacaacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174668 - RNA, 1410 nt, Artificial Sequence; identical to SEQ ID NO: 171171
  derived and/or modified sequence opt4 from neuraminidase__InfluenzaA__AFH74469

SEQ ID NO: 174669 - RNA, 1410 nt, Artificial Sequence; identical to SEQ ID NO: 169119
  derived and/or modified sequence opt4 from neuraminidase__InfluenzaA__AFH74480

SEQ ID NO: 174670 - RNA, 1410 nt, Artificial Sequence; identical to SEQ ID NO: 169119
  derived and/or modified sequence opt4 from neuraminidase__InfluenzaA__AFH74491

SEQ ID NO: 174671 - RNA, 1410 nt, Artificial Sequence; identical to SEQ ID NO: 174162
  derived and/or modified sequence opt4 from neuraminidase__InfluenzaA__AFH74502

SEQ ID NO: 174672 - RNA, 1410 nt, Artificial Sequence
  derived and/or modified sequence opt4 from neuraminidase__InfluenzaA__AFH74513
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaccugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174673 - RNA, 1410 nt, Artificial Sequence
  derived and/or modified sequence opt4 from neuraminidase__InfluenzaA__AFH74524
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccaccaucaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcguggugguguucugcggcaccagcggcaccuacggcaccggcagcuggcccgacggcgccgacaucaaccugaugcccaucuga

SEQ ID NO: 174674 - RNA, 1410 nt, Artificial Sequence; identical to SEQ ID NO: 169119
  derived and/or modified sequence opt4 from neuraminidase__InfluenzaA__AFH74535

SEQ ID NO: 174675 - RNA, 1410 nt, Artificial Sequence; identical to SEQ ID NO: 174155
  derived and/or modified sequence opt4 from neuraminidase__InfluenzaA__AFH74546

SEQ ID NO: 174676 - RNA, 1410 nt, Artificial Sequence; identical to SEQ ID NO: 174155
  derived and/or modified sequence opt4 from neuraminidase__InfluenzaA__AFH74557

SEQ ID NO: 174677 - RNA, 1410 nt, Artificial Sequence; identical to SEQ ID NO: 174155
  derived and/or modified sequence opt4 from neuraminidase__InfluenzaA__AFH74568

SEQ ID NO: 174678 - RNA, 1410 nt, Artificial Sequence; identical to SEQ ID NO: 174158
  derived and/or modified sequence opt4 from neuraminidase__InfluenzaA__AFH74579

SEQ ID NO: 174679 - RNA, 1410 nt, Artificial Sequence
  derived and/or modified sequence opt4 from neuraminidase__InfluenzaA__AFH74590
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugagcguguga

SEQ ID NO: 174680 - RNA, 1410 nt, Artificial Sequence; identical to SEQ ID NO: 174155
  derived and/or modified sequence opt4 from neuraminidase__InfluenzaA__AFH74601

SEQ ID NO: 174681 - RNA, 1410 nt, Artificial Sequence
  derived and/or modified sequence opt4 from neuraminidase__InfluenzaA__AFH74612
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugagcaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174682 - RNA, 1410 nt, Artificial Sequence; identical to SEQ ID NO: 174155
  derived and/or modified sequence opt4 from neuraminidase__InfluenzaA__AFH74623

SEQ ID NO: 174683 - RNA, 1410 nt, Artificial Sequence; identical to SEQ ID NO: 174155
  derived and/or modified sequence opt4 from neuraminidase__InfluenzaA__AFH74634

SEQ ID NO: 174684 - RNA, 1410 nt, Artificial Sequence; identical to SEQ ID NO: 174162
  derived and/or modified sequence opt4 from neuraminidase__InfluenzaA__AFH74645

SEQ ID NO: 174685 - RNA, 1410 nt, Artificial Sequence; identical to SEQ ID NO: 174162
  derived and/or modified sequence opt4 from neuraminidase__InfluenzaA__AFH74656

SEQ ID NO: 174686 - RNA, 1410 nt, Artificial Sequence; identical to SEQ ID NO: 174162
  derived and/or modified sequence opt4 from neuraminidase__InfluenzaA__AFH74667

SEQ ID NO: 174687 - RNA, 1410 nt, Artificial Sequence; identical to SEQ ID NO: 174162
  derived and/or modified sequence opt4 from neuraminidase__InfluenzaA__AFH74678

SEQ ID NO: 174688 - RNA, 1410 nt, Artificial Sequence; identical to SEQ ID NO: 169119
  derived and/or modified sequence opt4 from neuraminidase__InfluenzaA__AFH74689

SEQ ID NO: 174689 - RNA, 1410 nt, Artificial Sequence; identical to SEQ ID NO: 169119
  derived and/or modified sequence opt4 from neuraminidase__InfluenzaA__AFH74700

SEQ ID NO: 174690 - RNA, 1410 nt, Artificial Sequence
  derived and/or modified sequence opt4 from neuraminidase__InfluenzaA__AFH74711
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccugcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174691 - RNA, 1410 nt, Artificial Sequence; identical to SEQ ID NO: 174155
  derived and/or modified sequence opt4 from neuraminidase__InfluenzaA__AFH74722

SEQ ID NO: 174692 - RNA, 1410 nt, Artificial Sequence; identical to SEQ ID NO: 174155
  derived and/or modified sequence opt4 from neuraminidase__InfluenzaA__AFH74733

SEQ ID NO: 174693 - RNA, 1410 nt, Artificial Sequence
  derived and/or modified sequence opt4 from neuraminidase__InfluenzaA__AFH74744
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcaacuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174694 - RNA, 1410 nt, Artificial Sequence; identical to SEQ ID NO: 174155
  derived and/or modified sequence opt4 from neuraminidase__InfluenzaA__AFH74755

SEQ ID NO: 174695 - RNA, 1410 nt, Artificial Sequence; identical to SEQ ID NO: 174155
  derived and/or modified sequence opt4 from neuraminidase__InfluenzaA__AFH74766

SEQ ID NO: 174696 - RNA, 1410 nt, Artificial Sequence; identical to SEQ ID NO: 174155
  derived and/or modified sequence opt4 from neuraminidase__InfluenzaA__AFH74777

SEQ ID NO: 174697 - RNA, 1410 nt, Artificial Sequence; identical to SEQ ID NO: 169119
  derived and/or modified sequence opt4 from neuraminidase__InfluenzaA__AFH74788

SEQ ID NO: 174698 - RNA, 1410 nt, Artificial Sequence
  derived and/or modified sequence opt4 from neuraminidase__InfluenzaA__AFH74799
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174699 - RNA, 1410 nt, Artificial Sequence; identical to SEQ ID NO: 174175
  derived and/or modified sequence opt4 from neuraminidase__InfluenzaA__AFH74810

SEQ ID NO: 174700 - RNA, 1410 nt, Artificial Sequence; identical to SEQ ID NO: 174175
  derived and/or modified sequence opt4 from neuraminidase__InfluenzaA__AFH74821

SEQ ID NO: 174701 - RNA, 1410 nt, Artificial Sequence; identical to SEQ ID NO: 174175
  derived and/or modified sequence opt4 from neuraminidase__InfluenzaA__AFH74832

SEQ ID NO: 174702 - RNA, 1410 nt, Artificial Sequence; identical to SEQ ID NO: 174175
  derived and/or modified sequence opt4 from neuraminidase__InfluenzaA__AFH74843

SEQ ID NO: 174703 - RNA, 1410 nt, Artificial Sequence; identical to SEQ ID NO: 174155
  derived and/or modified sequence opt4 from neuraminidase__InfluenzaA__AFH74854

SEQ ID NO: 174704 - RNA, 1410 nt, Artificial Sequence; identical to SEQ ID NO: 174155
  derived and/or modified sequence opt4 from neuraminidase__InfluenzaA__AFH74865

SEQ ID NO: 174705 - RNA, 1410 nt, Artificial Sequence; identical to SEQ ID NO: 174155
  derived and/or modified sequence opt4 from neuraminidase__InfluenzaA__AFH74876

SEQ ID NO: 174706 - RNA, 1410 nt, Artificial Sequence; identical to SEQ ID NO: 174155
  derived and/or modified sequence opt4 from neuraminidase__InfluenzaA__AFH74887

SEQ ID NO: 174707 - RNA, 1410 nt, Artificial Sequence; identical to SEQ ID NO: 174155
  derived and/or modified sequence opt4 from neuraminidase__InfluenzaA__AFH74898

SEQ ID NO: 174708 - RNA, 1410 nt, Artificial Sequence; identical to SEQ ID NO: 174155
  derived and/or modified sequence opt4 from neuraminidase__InfluenzaA__AFH74909

SEQ ID NO: 174709 - RNA, 1410 nt, Artificial Sequence
  derived and/or modified sequence opt4 from neuraminidase__InfluenzaA__AFH74920
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174710 - RNA, 1410 nt, Artificial Sequence; identical to SEQ ID NO: 169119
  derived and/or modified sequence opt4 from neuraminidase__InfluenzaA__AFH74931

SEQ ID NO: 174711 - RNA, 1410 nt, Artificial Sequence; identical to SEQ ID NO: 169119
  derived and/or modified sequence opt4 from neuraminidase__InfluenzaA__AFH74942

SEQ ID NO: 174712 - RNA, 1410 nt, Artificial Sequence; identical to SEQ ID NO: 174155
  derived and/or modified sequence opt4 from neuraminidase__InfluenzaA__AFH74953

SEQ ID NO: 174713 - RNA, 1410 nt, Artificial Sequence
  derived and/or modified sequence opt4 from neuraminidase__InfluenzaA__AFH74964
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcauccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 174714 - RNA, 1410 nt, Artificial Sequence; identical to SEQ ID NO: 174155
  derived and/or modified sequence opt4 from neuraminidase__InfluenzaA__AFH75391

SEQ ID NO: 174715 - RNA, 1410 nt, Artificial Sequence; identical to SEQ ID NO: 169258
  derived and/or modified sequence opt4 from neuraminidase__InfluenzaA__AFH97143

SEQ ID NO: 174716 - RNA, 1410 nt, Artificial Sequence
  derived and/or modified sequence opt4 from neuraminidase__InfluenzaA__AFI56407
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcaacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 174717 - RNA, 1410 nt, Artificial Sequence
  derived and/or modified sequence opt4 from neuraminidase__InfluenzaA__AFJ05141
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaagccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174718 - RNA, 1410 nt, Artificial Sequence
  derived and/or modified sequence opt4 from neuraminidase__InfluenzaA__AFJ05145
augaaccccaaccagaagaucaucaccaucggcagcgugagccugaccaugagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174719 - RNA, 1410 nt, Artificial Sequence
  derived and/or modified sequence opt4 from neuraminidase__InfluenzaA__AFJ05635
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcaugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174720 - RNA, 1410 nt, Artificial Sequence
  derived and/or modified sequence opt4 from neuraminidase__InfluenzaA__AFJ11709
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcugaucuga

SEQ ID NO: 174721 - RNA, 1410 nt, Artificial Sequence
  derived and/or modified sequence opt4 from neuraminidase__InfluenzaA__AFJ11720
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugaucgacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174722 - RNA, 1410 nt, Artificial Sequence; identical to SEQ ID NO: 173663
  derived and/or modified sequence opt4 from neuraminidase__InfluenzaA__AFJ11731

SEQ ID NO: 174723 - RNA, 1410 nt, Artificial Sequence
  derived and/or modified sequence opt4 from neuraminidase__InfluenzaA__AFJ19845
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccgacgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 174724 - RNA, 1410 nt, Artificial Sequence; identical to SEQ ID NO: 169258
  derived and/or modified sequence opt4 from neuraminidase__InfluenzaA__AFJ44697

SEQ ID NO: 174725 - RNA, 1410 nt, Artificial Sequence; identical to SEQ ID NO: 172777
  derived and/or modified sequence opt4 from neuraminidase__InfluenzaA__AFJ69989

SEQ ID NO: 174726 - RNA, 1410 nt, Artificial Sequence
  derived and/or modified sequence opt4 from neuraminidase__InfluenzaA__AFJ69990
augaaccccaaccagaagaucaucaccaucggcagcgugugcaugaccaucggcauggccaaccugauccugcagaucggcaacaucaccagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174727 - RNA, 1410 nt, Artificial Sequence
  derived and/or modified sequence opt4 from neuraminidase__InfluenzaA__AFJ69991
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaaccaggaccugagccacagcgccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174728 - RNA, 1410 nt, Artificial Sequence; identical to SEQ ID NO: 170084
  derived and/or modified sequence opt4 from neuraminidase__InfluenzaA__AFJ69992

SEQ ID NO: 174729 - RNA, 1410 nt, Artificial Sequence
  derived and/or modified sequence opt4 from neuraminidase__InfluenzaA__AFJ69993
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugggcagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaaccugaaccugaugcccaucuga

SEQ ID NO: 174730 - RNA, 1410 nt, Artificial Sequence; identical to SEQ ID NO: 172038
  derived and/or modified sequence opt4 from neuraminidase__InfluenzaA__AFJ69994

SEQ ID NO: 174731 - RNA, 1413 nt, Artificial Sequence
  derived and/or modified sequence opt4 from neuraminidase__InfluenzaA__AFJ74389
augaaccccaaccagaagaucaucaccaucggcagcaucagcaucgccaucggcaucaucagccugauccugcagaucggcaacaucaucagcaucugggccagccacagcauccagaccggcagccagaaccacaccggcgugugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174732 - RNA, 1410 nt, Artificial Sequence
  derived and/or modified sequence opt4 from neuraminidase__InfluenzaA__AFJ74399
augaaccccaaccagaagaucaucaccaucggcagcgugagccugaccaucgccaccaucugcuuccugaugcagaucgccauccuggugaucacccugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuucagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174733 - RNA, 1410 nt, Artificial Sequence
  derived and/or modified sequence opt4 from neuraminidase__InfluenzaA__AFJ74410
augaaccccaaccagaagaucaucaccaucggcagcgugagccugaccaucgccaccaucugcuuccugaugcagaucgccauccuggugaugaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucaucagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174734 - RNA, 1410 nt, Artificial Sequence; identical to SEQ ID NO: 166835
  derived and/or modified sequence opt4 from neuraminidase__InfluenzaA__AFJ74451

SEQ ID NO: 174735 - RNA, 1413 nt, Artificial Sequence
  derived and/or modified sequence opt4 from neuraminidase__InfluenzaA__AFJ74462
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 174736 - RNA, 1410 nt, Artificial Sequence
  derived and/or modified sequence opt4 from neuraminidase__InfluenzaA__AFJ74517
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguacaugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaacgaggugugguggaccagcaacagcaucgugguguucugcggcaccagcggcaccuacggcaccggcagcuggcccgacggcgccgacaucaaccugaugcccaucuga

SEQ ID NO: 174737 - RNA, 1410 nt, Artificial Sequence
  derived and/or modified sequence opt4 from neuraminidase__InfluenzaA__AFJ74564
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaccgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagacccugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174738 - RNA, 1413 nt, Artificial Sequence
  derived and/or modified sequence opt4 from neuraminidase__InfluenzaA__AFJ74639
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacaacaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccagcuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174739 - RNA, 1410 nt, Artificial Sequence
  derived and/or modified sequence opt4 from neuraminidase__InfluenzaA__AFJ74640
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccggcuacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacaagggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174740 - RNA, 1413 nt, Artificial Sequence; identical to SEQ ID NO: 174738
  derived and/or modified sequence opt4 from neuraminidase__InfluenzaA__AFJ74659

SEQ ID NO: 174741 - RNA, 1413 nt, Artificial Sequence
  derived and/or modified sequence opt4 from neuraminidase__InfluenzaA__AFJ74679
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacaacaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccagcuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174742 - RNA, 1410 nt, Artificial Sequence
  derived and/or modified sequence opt4 from neuraminidase__InfluenzaA__AFJ74680
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugauccugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174743 - RNA, 1410 nt, Artificial Sequence
  derived and/or modified sequence opt4 from neuraminidase__InfluenzaA__AFJ74701
augaaccccaaccagaagaucaucaccaucggcagcgugagccugaccaucgccaccaucugcuuccugaugcagaucgccauccuggugaccaccgugacccugcacuucaaccaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaucuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcauggccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcaggugaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174744 - RNA, 1410 nt, Artificial Sequence
  derived and/or modified sequence opt4 from neuraminidase__InfluenzaA__AFJ74731
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgagaucaaccugaugcccaucuga

SEQ ID NO: 174745 - RNA, 1413 nt, Artificial Sequence; identical to SEQ ID NO: 174738
  derived and/or modified sequence opt4 from neuraminidase__InfluenzaA__AFJ74766

SEQ ID NO: 174746 - RNA, 1410 nt, Artificial Sequence
  derived and/or modified sequence opt4 from neuraminidase__InfluenzaA__AFJ74767
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 174747 - RNA, 1410 nt, Artificial Sequence; identical to SEQ ID NO: 174746
  derived and/or modified sequence opt4 from neuraminidase__InfluenzaA__AFJ74783

SEQ ID NO: 174748 - RNA, 1410 nt, Artificial Sequence; identical to SEQ ID NO: 166665
  derived and/or modified sequence opt4 from neuraminidase__InfluenzaA__AFJ74807

SEQ ID NO: 174749 - RNA, 1410 nt, Artificial Sequence; identical to SEQ ID NO: 166665
  derived and/or modified sequence opt4 from neuraminidase__InfluenzaA__AFJ74822

SEQ ID NO: 174750 - RNA, 1410 nt, Artificial Sequence; identical to SEQ ID NO: 167234
  derived and/or modified sequence opt4 from neuraminidase__InfluenzaA__AFJ74834

SEQ ID NO: 174751 - RNA, 1410 nt, Artificial Sequence; identical to SEQ ID NO: 166665
  derived and/or modified sequence opt4 from neuraminidase__InfluenzaA__AFJ74845

SEQ ID NO: 174752 - RNA, 1413 nt, Artificial Sequence
  derived and/or modified sequence opt4 from neuraminidase__InfluenzaA__AFJ75039
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccagcgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcggcgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccaucgacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174753 - RNA, 1410 nt, Artificial Sequence
  derived and/or modified sequence opt4 from neuraminidase__InfluenzaA__AFJ75050
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcgugagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucguggagggcaagaucgugcacaccagcgcccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174754 - RNA, 1410 nt, Artificial Sequence
  derived and/or modified sequence opt4 from neuraminidase__InfluenzaA__AFJ75094
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagcaacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaucgaggugcuguggaccagcaacagcaucgugguguucugcggcaccagcggcaccuacggcaccggcagcuggcccgacggcgccgacaucaacaucaugcccaucuga

SEQ ID NO: 174755 - RNA, 1413 nt, Artificial Sequence
  derived and/or modified sequence opt4 from neuraminidase__InfluenzaA__AFJ75104
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggccggcaacagcagccugugcagcaucagcggcugggccauccacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaucgccaacuggagcuggcccgacggcgccgagcugcccuucaccaucgacaaguga

SEQ ID NO: 174756 - RNA, 1410 nt, Artificial Sequence; identical to SEQ ID NO: 168404
  derived and/or modified sequence opt4 from neuraminidase__InfluenzaA__AFJ75114

SEQ ID NO: 174757 - RNA, 1410 nt, Artificial Sequence; identical to SEQ ID NO: 168404
  derived and/or modified sequence opt4 from neuraminidase__InfluenzaA__AFJ75452

SEQ ID NO: 174758 - RNA, 1410 nt, Artificial Sequence; identical to SEQ ID NO: 168404
  derived and/or modified sequence opt4 from neuraminidase__InfluenzaA__AFJ75463

SEQ ID NO: 174759 - RNA, 1413 nt, Artificial Sequence; identical to SEQ ID NO: 174755
  derived and/or modified sequence opt4 from neuraminidase__InfluenzaA__AFJ75552

SEQ ID NO: 174760 - RNA, 1413 nt, Artificial Sequence
  derived and/or modified sequence opt4 from neuraminidase__InfluenzaA__AFJ75574
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggccggcaacagcagccugugcagcaucagcggcugggccauccacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagggccagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaucgccaacuggagcuggcccgacggcgccgagcugcccuucaccaucgacaaguga

SEQ ID NO: 174761 - RNA, 1410 nt, Artificial Sequence; identical to SEQ ID NO: 168404
  derived and/or modified sequence opt4 from neuraminidase__InfluenzaA__AFJ75585

SEQ ID NO: 174762 - RNA, 1410 nt, Artificial Sequence
  derived and/or modified sequence opt4 from neuraminidase__InfluenzaA__AFJ75596
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174763 - RNA, 1410 nt, Artificial Sequence
  derived and/or modified sequence opt4 from neuraminidase__InfluenzaA__AFJ75607
augaaccccacccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgagaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcggcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174764 - RNA, 1410 nt, Artificial Sequence
  derived and/or modified sequence opt4 from neuraminidase__InfluenzaA__AFJ75633
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174765 - RNA, 1413 nt, Artificial Sequence; identical to SEQ ID NO: 169981
  derived and/or modified sequence opt4 from neuraminidase__InfluenzaA__AFJ75654

SEQ ID NO: 174766 - RNA, 1410 nt, Artificial Sequence; identical to SEQ ID NO: 168404
  derived and/or modified sequence opt4 from neuraminidase__InfluenzaA__AFJ75665

SEQ ID NO: 174767 - RNA, 1413 nt, Artificial Sequence
  derived and/or modified sequence opt4 from neuraminidase__InfluenzaA__AFJ75676
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggccggcaacagcagccugugcagcaucagcggcugggccauccacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaucgccaacuggagcuggcccgacggcgccgagcugcccuucaccaucgacaaguga

SEQ ID NO: 174768 - RNA, 1413 nt, Artificial Sequence; identical to SEQ ID NO: 169981
  derived and/or modified sequence opt4 from neuraminidase__InfluenzaA__AFJ75687

SEQ ID NO: 174769 - RNA, 1410 nt, Artificial Sequence; identical to SEQ ID NO: 169258
  derived and/or modified sequence opt4 from neuraminidase__InfluenzaA__AFJ76122

SEQ ID NO: 174770 - RNA, 1410 nt, Artificial Sequence; identical to SEQ ID NO: 173836
  derived and/or modified sequence opt4 from neuraminidase__InfluenzaA__AFJ76134

SEQ ID NO: 174771 - RNA, 1410 nt, Artificial Sequence; identical to SEQ ID NO: 169258
  derived and/or modified sequence opt4 from neuraminidase__InfluenzaA__AFJ76146

SEQ ID NO: 174772 - RNA, 1410 nt, Artificial Sequence; identical to SEQ ID NO: 169258
  derived and/or modified sequence opt4 from neuraminidase__InfluenzaA__AFJ76159

SEQ ID NO: 174773 - RNA, 1410 nt, Artificial Sequence; identical to SEQ ID NO: 169258
  derived and/or modified sequence opt4 from neuraminidase__InfluenzaA__AFJ76173

SEQ ID NO: 174774 - RNA, 1410 nt, Artificial Sequence; identical to SEQ ID NO: 169258
  derived and/or modified sequence opt4 from neuraminidase__InfluenzaA__AFJ76191

SEQ ID NO: 174775 - RNA, 1413 nt, Artificial Sequence
  derived and/or modified sequence opt4 from neuraminidase__InfluenzaA__AFJ76192
augaaccccaaccagaagaucaucaccaucggcagcaucagcaucgccaucggcaucaucagccugauggugcagaucggcaacaucaucagcaucugggccagccacagcauccagaccggcauccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174776 - RNA, 1410 nt, Artificial Sequence; identical to SEQ ID NO: 169258
  derived and/or modified sequence opt4 from neuraminidase__InfluenzaA__AFJ76206

SEQ ID NO: 174777 - RNA, 1410 nt, Artificial Sequence
  derived and/or modified sequence opt4 from neuraminidase__InfluenzaA__AFJ76216
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucaagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174778 - RNA, 1410 nt, Artificial Sequence
  derived and/or modified sequence opt4 from neuraminidase__InfluenzaA__AFJ77411
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174779 - RNA, 1410 nt, Artificial Sequence
  derived and/or modified sequence opt4 from neuraminidase__InfluenzaA__AFJ77422
augaaccccaaccagaagaucaucaccaucggcagcgugagccugaccaucgccaccaucugcuuccugaugcagaucgccauccuggugaucaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuucgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174780 - RNA, 1410 nt, Artificial Sequence
  derived and/or modified sequence opt4 from neuraminidase__InfluenzaA__AFJ77433
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaccgacagcagcagcagcagcgacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcgugaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174781 - RNA, 1410 nt, Artificial Sequence
  derived and/or modified sequence opt4 from neuraminidase__InfluenzaA__AFJ77443
augaaccccaaccagaagaucaucaccaucggcagcgugagccugaccaucgccaccaucugcuuccugaugcagaucgccauccuggugaucacccugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuucagcaucgugagcagcuacgugugcagcggccuggugggcgacacccccagaaagaacgacagcagcagcagcagccacugccugaaccccaacaacgaggagggcggcaacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174782 - RNA, 1410 nt, Artificial Sequence
  derived and/or modified sequence opt4 from neuraminidase__InfluenzaA__AFJ77465
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaagaacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174783 - RNA, 1410 nt, Artificial Sequence
  derived and/or modified sequence opt4 from neuraminidase__InfluenzaA__AFJ77476
augaaccccaaccagaagaucaucaccaucggcagcgugagccugaccaucgccaccaucugcuuccugaugcagaucgccauccuggugaccaccgugacccugcacuucaagcaguacgagugcaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacggcggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaaguucagaagcggcuacgagaccuucaaggugaucgagggcuggagcaagcccaacagcaagcugcagaucaacagacagaucaucguggacagagacaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174784 - RNA, 1410 nt, Artificial Sequence; identical to SEQ ID NO: 166835
  derived and/or modified sequence opt4 from neuraminidase__InfluenzaA__AFJ77487

SEQ ID NO: 174785 - RNA, 1410 nt, Artificial Sequence
  derived and/or modified sequence opt4 from neuraminidase__InfluenzaA__AFJ77498
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacgugaaggacuacagcaucaucagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggagagaggcaacaugagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174786 - RNA, 1410 nt, Artificial Sequence; identical to SEQ ID NO: 166835
  derived and/or modified sequence opt4 from neuraminidase__InfluenzaA__AFJ77509

SEQ ID NO: 174787 - RNA, 1410 nt, Artificial Sequence
  derived and/or modified sequence opt4 from neuraminidase__InfluenzaA__AFJ77520
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaucgaggugcuguggaccagcaacagcaucgugguguucugcggcaccagcggcaccuacggcaccggcagcuggcccgacggcgccgacaucaaccugaugcccaucuga

SEQ ID NO: 174788 - RNA, 1410 nt, Artificial Sequence
  derived and/or modified sequence opt4 from neuraminidase__InfluenzaA__AFJ77531
augaaccccaaccagaagaucaucaccaucggcagcgugagccugaccaucaccaccaucugcuuccugaugcagaucgccauccuggugaucaccgugacccugcacuucaagcagugcgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaaggugaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacaacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugccuggaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 174789 - RNA, 1410 nt, Artificial Sequence
  derived and/or modified sequence opt4 from neuraminidase__InfluenzaA__AFJ77542
augaaccccaaccagaagaucaucaccaucggcagcgugagccugaccaucagcaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174790 - RNA, 1410 nt, Artificial Sequence; identical to SEQ ID NO: 166773
  derived and/or modified sequence opt4 from neuraminidase__InfluenzaA__AFJ77553

SEQ ID NO: 174791 - RNA, 1410 nt, Artificial Sequence
  derived and/or modified sequence opt4 from neuraminidase__InfluenzaA__AFJ77564
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaacgaggugugguggaccagcaacagcaucgugguguucugcggcaccagcggcaccuacggcaccggcagcuggcccgacggcgccgacaucaaccugaugcccaucuga

SEQ ID NO: 174792 - RNA, 1329 nt, Artificial Sequence
  derived and/or modified sequence opt4 from neuraminidase__InfluenzaA__AFJ77575
augaaccccaaccagaagaucaucaccaucggcagcgugagccugaccaucgccaccaucugcuuccugaugcagaucgccauccuggugaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174793 - RNA, 1410 nt, Artificial Sequence
  derived and/or modified sequence opt4 from neuraminidase__InfluenzaA__AFJ77597
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagaccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174794 - RNA, 1410 nt, Artificial Sequence
  derived and/or modified sequence opt4 from neuraminidase__InfluenzaA__AFJ77608
augaaccccaaccagaagaucaucaccaucggcagcgugagccugaccaucgccaccaucugcuuccugaugcagaccgccauccuggugaccaccgugacccugcacuucaagcaguacgagugcaacagcccccccaacaaccaggugaugcugugcgagcccaccaucaucgagagaaacaugaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgaccugugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174795 - RNA, 1410 nt, Artificial Sequence; identical to SEQ ID NO: 174793
  derived and/or modified sequence opt4 from neuraminidase__InfluenzaA__AFJ77619

SEQ ID NO: 174796 - RNA, 1410 nt, Artificial Sequence; identical to SEQ ID NO: 174793
  derived and/or modified sequence opt4 from neuraminidase__InfluenzaA__AFJ77630

SEQ ID NO: 174797 - RNA, 1410 nt, Artificial Sequence; identical to SEQ ID NO: 174789
  derived and/or modified sequence opt4 from neuraminidase__InfluenzaA__AFJ77641

SEQ ID NO: 174798 - RNA, 1410 nt, Artificial Sequence; identical to SEQ ID NO: 174789
  derived and/or modified sequence opt4 from neuraminidase__InfluenzaA__AFJ77652

SEQ ID NO: 174799 - RNA, 1410 nt, Artificial Sequence; identical to SEQ ID NO: 166560
  derived and/or modified sequence opt4 from neuraminidase__InfluenzaA__AFJ77663

SEQ ID NO: 174800 - RNA, 1410 nt, Artificial Sequence; identical to SEQ ID NO: 166560
  derived and/or modified sequence opt4 from neuraminidase__InfluenzaA__AFJ77674

SEQ ID NO: 174801 - RNA, 1410 nt, Artificial Sequence; identical to SEQ ID NO: 166560
  derived and/or modified sequence opt4 from neuraminidase__InfluenzaA__AFJ77685

SEQ ID NO: 174802 - RNA, 1410 nt, Artificial Sequence
  derived and/or modified sequence opt4 from neuraminidase__InfluenzaA__AFJ77696
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcgagaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174803 - RNA, 1410 nt, Artificial Sequence; identical to SEQ ID NO: 166560
  derived and/or modified sequence opt4 from neuraminidase__InfluenzaA__AFJ77707

SEQ ID NO: 174804 - RNA, 1410 nt, Artificial Sequence; identical to SEQ ID NO: 166581
  derived and/or modified sequence opt4 from neuraminidase__InfluenzaA__AFJ77718

SEQ ID NO: 174805 - RNA, 1410 nt, Artificial Sequence; identical to SEQ ID NO: 166581
  derived and/or modified sequence opt4 from neuraminidase__InfluenzaA__AFJ77729

SEQ ID NO: 174806 - RNA, 1410 nt, Artificial Sequence
  derived and/or modified sequence opt4 from neuraminidase__InfluenzaA__AFJ77740
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaucguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 174807 - RNA, 1410 nt, Artificial Sequence
  derived and/or modified sequence opt4 from neuraminidase__InfluenzaA__AFJ77751
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugagagacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucuucagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 174808 - RNA, 1410 nt, Artificial Sequence; identical to SEQ ID NO: 166665
  derived and/or modified sequence opt4 from neuraminidase__InfluenzaA__AFJ77762

SEQ ID NO: 174809 - RNA, 1410 nt, Artificial Sequence; identical to SEQ ID NO: 166665
  derived and/or modified sequence opt4 from neuraminidase__InfluenzaA__AFJ77773

SEQ ID NO: 174810 - RNA, 1410 nt, Artificial Sequence; identical to SEQ ID NO: 166665
  derived and/or modified sequence opt4 from neuraminidase__InfluenzaA__AFJ77784

SEQ ID NO: 174811 - RNA, 1410 nt, Artificial Sequence; identical to SEQ ID NO: 167234
  derived and/or modified sequence opt4 from neuraminidase__InfluenzaA__AFJ77795

SEQ ID NO: 174812 - RNA, 1410 nt, Artificial Sequence; identical to SEQ ID NO: 167234
  derived and/or modified sequence opt4 from neuraminidase__InfluenzaA__AFJ77806

SEQ ID NO: 174813 - RNA, 1410 nt, Artificial Sequence; identical to SEQ ID NO: 167234
  derived and/or modified sequence opt4 from neuraminidase__InfluenzaA__AFJ77817

SEQ ID NO: 174814 - RNA, 1410 nt, Artificial Sequence; identical to SEQ ID NO: 167234
  derived and/or modified sequence opt4 from neuraminidase__InfluenzaA__AFJ77828

SEQ ID NO: 174815 - RNA, 1410 nt, Artificial Sequence
  derived and/or modified sequence opt4 from neuraminidase__InfluenzaA__AFJ77839
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174816 - RNA, 1410 nt, Artificial Sequence
  derived and/or modified sequence opt4 from neuraminidase__InfluenzaA__AFJ77850
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccaaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174817 - RNA, 1410 nt, Artificial Sequence; identical to SEQ ID NO: 167234
  derived and/or modified sequence opt4 from neuraminidase__InfluenzaA__AFJ77861

SEQ ID NO: 174818 - RNA, 1410 nt, Artificial Sequence; identical to SEQ ID NO: 167234
  derived and/or modified sequence opt4 from neuraminidase__InfluenzaA__AFJ77872

SEQ ID NO: 174819 - RNA, 1410 nt, Artificial Sequence; identical to SEQ ID NO: 167700
  derived and/or modified sequence opt4 from neuraminidase__InfluenzaA__AFJ77883

SEQ ID NO: 174820 - RNA, 1410 nt, Artificial Sequence; identical to SEQ ID NO: 167234
  derived and/or modified sequence opt4 from neuraminidase__InfluenzaA__AFJ77894

SEQ ID NO: 174821 - RNA, 1410 nt, Artificial Sequence; identical to SEQ ID NO: 167234
  derived and/or modified sequence opt4 from neuraminidase__InfluenzaA__AFJ77905

SEQ ID NO: 174822 - RNA, 1410 nt, Artificial Sequence
  derived and/or modified sequence opt4 from neuraminidase__InfluenzaA__AFJ77916
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucaucguguucugcggcaccagcggcaccuacggcaccggcagcuggcccgacggcgccgacaucaaccugaugcccaucuga

SEQ ID NO: 174823 - RNA, 1410 nt, Artificial Sequence; identical to SEQ ID NO: 167256
  derived and/or modified sequence opt4 from neuraminidase__InfluenzaA__AFJ77927

SEQ ID NO: 174824 - RNA, 1410 nt, Artificial Sequence; identical to SEQ ID NO: 167256
  derived and/or modified sequence opt4 from neuraminidase__InfluenzaA__AFJ77938

SEQ ID NO: 174825 - RNA, 1410 nt, Artificial Sequence; identical to SEQ ID NO: 167234
  derived and/or modified sequence opt4 from neuraminidase__InfluenzaA__AFJ77949

SEQ ID NO: 174826 - RNA, 1410 nt, Artificial Sequence; identical to SEQ ID NO: 167234
  derived and/or modified sequence opt4 from neuraminidase__InfluenzaA__AFJ77960

SEQ ID NO: 174827 - RNA, 1410 nt, Artificial Sequence
  derived and/or modified sequence opt4 from neuraminidase__InfluenzaA__AFJ77971
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggacgagaccgaggugcuguggaccagcaacagcaucgugguguucugcggcaccagcggcaccuacggcaccggcagcuggcccgacggcgccgacaucaaccugaugcccaucuga

SEQ ID NO: 174828 - RNA, 1410 nt, Artificial Sequence
  derived and/or modified sequence opt4 from neuraminidase__InfluenzaA__AFJ77982
augaaccccaaccagaagaucaucaccaucggcuucgugagccugaccaucagcaccaucugcuucuucaugcagaucgccauccugaucaccaccgugccccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggcaucgugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174829 - RNA, 1410 nt, Artificial Sequence; identical to SEQ ID NO: 167232
  derived and/or modified sequence opt4 from neuraminidase__InfluenzaA__AFJ77993

SEQ ID NO: 174830 - RNA, 1410 nt, Artificial Sequence
  derived and/or modified sequence opt4 from neuraminidase__InfluenzaA__AFJ78004
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174831 - RNA, 1410 nt, Artificial Sequence; identical to SEQ ID NO: 167232
  derived and/or modified sequence opt4 from neuraminidase__InfluenzaA__AFJ78015

SEQ ID NO: 174832 - RNA, 1410 nt, Artificial Sequence; identical to SEQ ID NO: 174089
  derived and/or modified sequence opt4 from neuraminidase__InfluenzaA__AFJ78026

SEQ ID NO: 174833 - RNA, 1410 nt, Artificial Sequence; identical to SEQ ID NO: 174089
  derived and/or modified sequence opt4 from neuraminidase__InfluenzaA__AFJ78037

SEQ ID NO: 174834 - RNA, 1410 nt, Artificial Sequence
  derived and/or modified sequence opt4 from neuraminidase__InfluenzaA__AFJ78048
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcaacgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174835 - RNA, 1410 nt, Artificial Sequence
  derived and/or modified sequence opt4 from neuraminidase__InfluenzaA__AFJ78059
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggacgagaccgaggugcuguggaccagcaacagcaucgugguguucugcggcaccagcggcaccuacggcaccggcagcuggcccgacggcgccgacaucaaccugaugcccaucuga

SEQ ID NO: 174836 - RNA, 1410 nt, Artificial Sequence
  derived and/or modified sequence opt4 from neuraminidase__InfluenzaA__AFJ78070
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174837 - RNA, 1410 nt, Artificial Sequence
  derived and/or modified sequence opt4 from neuraminidase__InfluenzaA__AFJ78081
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacaacagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174838 - RNA, 1410 nt, Artificial Sequence; identical to SEQ ID NO: 174754
  derived and/or modified sequence opt4 from neuraminidase__InfluenzaA__AFJ78092

SEQ ID NO: 174839 - RNA, 1410 nt, Artificial Sequence
  derived and/or modified sequence opt4 from neuraminidase__InfluenzaA__AFJ78103
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugcugggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccagcagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174840 - RNA, 1410 nt, Artificial Sequence
  derived and/or modified sequence opt4 from neuraminidase__InfluenzaA__AFJ78114
augaaccccaaccagaagaucaucaccaucggcagcgugagccugaccaucagcaccaucugcuucuucaugcagaucgccauccugaucaccaccgugacccugcacuucaagcaguacgagcugaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaucaacagacaggugaucguggacagaagcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174841 - RNA, 1410 nt, Artificial Sequence
  derived and/or modified sequence opt4 from neuraminidase__InfluenzaA__AFJ78125
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174842 - RNA, 1410 nt, Artificial Sequence
  derived and/or modified sequence opt4 from neuraminidase__InfluenzaA__AFJ78136
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174843 - RNA, 1410 nt, Artificial Sequence; identical to SEQ ID NO: 174842
  derived and/or modified sequence opt4 from neuraminidase__InfluenzaA__AFJ78147

SEQ ID NO: 174844 - RNA, 1410 nt, Artificial Sequence; identical to SEQ ID NO: 174842
  derived and/or modified sequence opt4 from neuraminidase__InfluenzaA__AFJ78158

SEQ ID NO: 174845 - RNA, 1410 nt, Artificial Sequence; identical to SEQ ID NO: 168404
  derived and/or modified sequence opt4 from neuraminidase__InfluenzaA__AFJ78169

SEQ ID NO: 174846 - RNA, 1410 nt, Artificial Sequence; identical to SEQ ID NO: 168922
  derived and/or modified sequence opt4 from neuraminidase__InfluenzaA__AFJ78180

SEQ ID NO: 174847 - RNA, 1410 nt, Artificial Sequence; identical to SEQ ID NO: 168404
  derived and/or modified sequence opt4 from neuraminidase__InfluenzaA__AFJ78191

SEQ ID NO: 174848 - RNA, 1410 nt, Artificial Sequence
  derived and/or modified sequence opt4 from neuraminidase__InfluenzaA__AFJ78202
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaucaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcggcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucagccugaugcccaucuga

SEQ ID NO: 174849 - RNA, 1410 nt, Artificial Sequence
  derived and/or modified sequence opt4 from neuraminidase__InfluenzaA__AFJ78213
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcugaucuga

SEQ ID NO: 174850 - RNA, 1410 nt, Artificial Sequence; identical to SEQ ID NO: 168404
  derived and/or modified sequence opt4 from neuraminidase__InfluenzaA__AFJ78224

SEQ ID NO: 174851 - RNA, 1410 nt, Artificial Sequence; identical to SEQ ID NO: 168404
  derived and/or modified sequence opt4 from neuraminidase__InfluenzaA__AFJ78235

SEQ ID NO: 174852 - RNA, 1410 nt, Artificial Sequence
  derived and/or modified sequence opt4 from neuraminidase__InfluenzaA__AFJ78246
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggccaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174853 - RNA, 1410 nt, Artificial Sequence
  derived and/or modified sequence opt4 from neuraminidase__InfluenzaA__AFJ78268
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174854 - RNA, 1410 nt, Artificial Sequence
  derived and/or modified sequence opt4 from neuraminidase__InfluenzaA__AFJ78279
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaucaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcggcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174855 - RNA, 1410 nt, Artificial Sequence
  derived and/or modified sequence opt4 from neuraminidase__InfluenzaA__AFJ78290
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcgcccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 174856 - RNA, 1413 nt, Artificial Sequence
  derived and/or modified sequence opt4 from neuraminidase__InfluenzaA__AFJ78312
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcugggagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174857 - RNA, 1410 nt, Artificial Sequence; identical to SEQ ID NO: 174789
  derived and/or modified sequence opt4 from neuraminidase__InfluenzaA__AFJ78323

SEQ ID NO: 174858 - RNA, 1413 nt, Artificial Sequence
  derived and/or modified sequence opt4 from neuraminidase__InfluenzaA__AFJ78334
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174859 - RNA, 1413 nt, Artificial Sequence; identical to SEQ ID NO: 174858
  derived and/or modified sequence opt4 from neuraminidase__InfluenzaA__AFJ78345

SEQ ID NO: 174860 - RNA, 1413 nt, Artificial Sequence
  derived and/or modified sequence opt4 from neuraminidase__InfluenzaA__AFJ78356
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggugggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcaucugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174861 - RNA, 1413 nt, Artificial Sequence
  derived and/or modified sequence opt4 from neuraminidase__InfluenzaA__AFJ78367
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 174862 - RNA, 1413 nt, Artificial Sequence
  derived and/or modified sequence opt4 from neuraminidase__InfluenzaA__AFJ78378
augaaccccaaccagaaggugaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccacauggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccagagacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucgccgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174863 - RNA, 1413 nt, Artificial Sequence; identical to SEQ ID NO: 166906
  derived and/or modified sequence opt4 from neuraminidase__InfluenzaA__AFJ78389

SEQ ID NO: 174864 - RNA, 1413 nt, Artificial Sequence; identical to SEQ ID NO: 166906
  derived and/or modified sequence opt4 from neuraminidase__InfluenzaA__AFJ78400

SEQ ID NO: 174865 - RNA, 1413 nt, Artificial Sequence; identical to SEQ ID NO: 166906
  derived and/or modified sequence opt4 from neuraminidase__InfluenzaA__AFJ78411

SEQ ID NO: 174866 - RNA, 1413 nt, Artificial Sequence
  derived and/or modified sequence opt4 from neuraminidase__InfluenzaA__AFJ78422
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaccggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccagcuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagaccccaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174867 - RNA, 1413 nt, Artificial Sequence; identical to SEQ ID NO: 169013
  derived and/or modified sequence opt4 from neuraminidase__InfluenzaA__AFJ78433

SEQ ID NO: 174868 - RNA, 1413 nt, Artificial Sequence; identical to SEQ ID NO: 169013
  derived and/or modified sequence opt4 from neuraminidase__InfluenzaA__AFJ78444

SEQ ID NO: 174869 - RNA, 1413 nt, Artificial Sequence
  derived and/or modified sequence opt4 from neuraminidase__InfluenzaA__AFJ78466
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaucaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagaugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174870 - RNA, 1413 nt, Artificial Sequence
  derived and/or modified sequence opt4 from neuraminidase__InfluenzaA__AFJ78477
augaaccccaaccagaagaucaucaccaucggcagcaucagcaucgccaucggcaucaucggccugaugcugcagaucggcaacaucaucagcaucugggccagccacagcauccagaccggcagccagaaccacaccggcaucugcagccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 174871 - RNA, 1413 nt, Artificial Sequence
  derived and/or modified sequence opt4 from neuraminidase__InfluenzaA__AFJ78488
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcaugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 174872 - RNA, 1413 nt, Artificial Sequence
  derived and/or modified sequence opt4 from neuraminidase__InfluenzaA__AFJ78510
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174873 - RNA, 1413 nt, Artificial Sequence
  derived and/or modified sequence opt4 from neuraminidase__InfluenzaA__AFJ78521
augaaccccaaccagaagaucaucaccaucggcagcaucagcaucgccaucggcaucaucagccugauccugcagaucggcaacaucaucagcaucugggccagccacagcauccagaccggcagccagaaccacaccggcaucugcaaccagagaaucaucaccuacgagaacagcaccugggugaacaacaccuacgugaacaucaacaacaccaacgugguggccgagaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagaccaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcggcaccgccaacuggagcuggcccgacggcgccgagcugcccuucaccaucgacaaguga

SEQ ID NO: 174874 - RNA, 1413 nt, Artificial Sequence; identical to SEQ ID NO: 174767
  derived and/or modified sequence opt4 from neuraminidase__InfluenzaA__AFJ78532

SEQ ID NO: 174875 - RNA, 1413 nt, Artificial Sequence; identical to SEQ ID NO: 174767
  derived and/or modified sequence opt4 from neuraminidase__InfluenzaA__AFJ78543

SEQ ID NO: 174876 - RNA, 1413 nt, Artificial Sequence; identical to SEQ ID NO: 174767
  derived and/or modified sequence opt4 from neuraminidase__InfluenzaA__AFJ78554

SEQ ID NO: 174877 - RNA, 1413 nt, Artificial Sequence; identical to SEQ ID NO: 174755
  derived and/or modified sequence opt4 from neuraminidase__InfluenzaA__AFJ78565

SEQ ID NO: 174878 - RNA, 1413 nt, Artificial Sequence
  derived and/or modified sequence opt4 from neuraminidase__InfluenzaA__AFJ78576
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagacccccgugacccuggccggcaacagcagccugugcagcaucagcggcugggccauccacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcaccggcguguucggcgacaaccccagacccgaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaucgccaacuggagcuggcccgacggcgccgagcugcccuucaccaucgacaaguga

SEQ ID NO: 174879 - RNA, 1413 nt, Artificial Sequence
  derived and/or modified sequence opt4 from neuraminidase__InfluenzaA__AFJ78598
augaaccccaaccagaagaucaucaccaucggcagcaucagcaucgccaucggcaucaucagccugaugcugcagaucggcaacaucaucagcaucugggccagccacagcauccagaccggcauccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174880 - RNA, 1413 nt, Artificial Sequence
  derived and/or modified sequence opt4 from neuraminidase__InfluenzaA__AFJ78609
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugauccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 174881 - RNA, 1413 nt, Artificial Sequence; identical to SEQ ID NO: 169981
  derived and/or modified sequence opt4 from neuraminidase__InfluenzaA__AFJ78620

SEQ ID NO: 174882 - RNA, 1413 nt, Artificial Sequence; identical to SEQ ID NO: 174755
  derived and/or modified sequence opt4 from neuraminidase__InfluenzaA__AFJ78631

SEQ ID NO: 174883 - RNA, 1413 nt, Artificial Sequence; identical to SEQ ID NO: 169981
  derived and/or modified sequence opt4 from neuraminidase__InfluenzaA__AFJ78642

SEQ ID NO: 174884 - RNA, 1413 nt, Artificial Sequence; identical to SEQ ID NO: 169981
  derived and/or modified sequence opt4 from neuraminidase__InfluenzaA__AFJ78653

SEQ ID NO: 174885 - RNA, 1410 nt, Artificial Sequence; identical to SEQ ID NO: 169258
  derived and/or modified sequence opt4 from neuraminidase__InfluenzaA__AFJ78664

SEQ ID NO: 174886 - RNA, 1410 nt, Artificial Sequence; identical to SEQ ID NO: 169258
  derived and/or modified sequence opt4 from neuraminidase__InfluenzaA__AFJ78674

SEQ ID NO: 174887 - RNA, 1410 nt, Artificial Sequence; identical to SEQ ID NO: 169258
  derived and/or modified sequence opt4 from neuraminidase__InfluenzaA__AFJ78684

SEQ ID NO: 174888 - RNA, 1410 nt, Artificial Sequence; identical to SEQ ID NO: 169258
  derived and/or modified sequence opt4 from neuraminidase__InfluenzaA__AFJ78694

SEQ ID NO: 174889 - RNA, 1410 nt, Artificial Sequence; identical to SEQ ID NO: 169258
  derived and/or modified sequence opt4 from neuraminidase__InfluenzaA__AFJ78704

SEQ ID NO: 174890 - RNA, 1410 nt, Artificial Sequence; identical to SEQ ID NO: 169258
  derived and/or modified sequence opt4 from neuraminidase__InfluenzaA__AFJ78714

SEQ ID NO: 174891 - RNA, 1410 nt, Artificial Sequence
  derived and/or modified sequence opt4 from neuraminidase__InfluenzaA__AFJ78724
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174892 - RNA, 1410 nt, Artificial Sequence; identical to SEQ ID NO: 169258
  derived and/or modified sequence opt4 from neuraminidase__InfluenzaA__AFJ78734

SEQ ID NO: 174893 - RNA, 1410 nt, Artificial Sequence; identical to SEQ ID NO: 169258
  derived and/or modified sequence opt4 from neuraminidase__InfluenzaA__AFJ78744

SEQ ID NO: 174894 - RNA, 1410 nt, Artificial Sequence; identical to SEQ ID NO: 169258
  derived and/or modified sequence opt4 from neuraminidase__InfluenzaA__AFJ78754

SEQ ID NO: 174895 - RNA, 1410 nt, Artificial Sequence; identical to SEQ ID NO: 169258
  derived and/or modified sequence opt4 from neuraminidase__InfluenzaA__AFJ78764

SEQ ID NO: 174896 - RNA, 1410 nt, Artificial Sequence; identical to SEQ ID NO: 169258
  derived and/or modified sequence opt4 from neuraminidase__InfluenzaA__AFJ78774

SEQ ID NO: 174897 - RNA, 1410 nt, Artificial Sequence; identical to SEQ ID NO: 169258
  derived and/or modified sequence opt4 from neuraminidase__InfluenzaA__AFJ78784

SEQ ID NO: 174898 - RNA, 1410 nt, Artificial Sequence
  derived and/or modified sequence opt4 from neuraminidase__InfluenzaA__AFJ78794
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcggcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174899 - RNA, 1410 nt, Artificial Sequence; identical to SEQ ID NO: 169258
  derived and/or modified sequence opt4 from neuraminidase__InfluenzaA__AFJ78804

SEQ ID NO: 174900 - RNA, 1410 nt, Artificial Sequence; identical to SEQ ID NO: 169258
  derived and/or modified sequence opt4 from neuraminidase__InfluenzaA__AFJ78814

SEQ ID NO: 174901 - RNA, 1410 nt, Artificial Sequence; identical to SEQ ID NO: 169258
  derived and/or modified sequence opt4 from neuraminidase__InfluenzaA__AFJ78824

SEQ ID NO: 174902 - RNA, 1410 nt, Artificial Sequence; identical to SEQ ID NO: 169258
  derived and/or modified sequence opt4 from neuraminidase__InfluenzaA__AFJ78834

SEQ ID NO: 174903 - RNA, 1410 nt, Artificial Sequence; identical to SEQ ID NO: 169258
  derived and/or modified sequence opt4 from neuraminidase__InfluenzaA__AFJ78844

SEQ ID NO: 174904 - RNA, 1410 nt, Artificial Sequence; identical to SEQ ID NO: 171507
  derived and/or modified sequence opt4 from neuraminidase__InfluenzaA__AFJ78854

SEQ ID NO: 174905 - RNA, 1410 nt, Artificial Sequence; identical to SEQ ID NO: 169258
  derived and/or modified sequence opt4 from neuraminidase__InfluenzaA__AFJ78864

SEQ ID NO: 174906 - RNA, 1410 nt, Artificial Sequence; identical to SEQ ID NO: 169258
  derived and/or modified sequence opt4 from neuraminidase__InfluenzaA__AFJ78874

SEQ ID NO: 174907 - RNA, 1410 nt, Artificial Sequence; identical to SEQ ID NO: 169258
  derived and/or modified sequence opt4 from neuraminidase__InfluenzaA__AFJ78884

SEQ ID NO: 174908 - RNA, 1410 nt, Artificial Sequence; identical to SEQ ID NO: 169258
  derived and/or modified sequence opt4 from neuraminidase__InfluenzaA__AFJ78894

SEQ ID NO: 174909 - RNA, 1410 nt, Artificial Sequence; identical to SEQ ID NO: 169258
  derived and/or modified sequence opt4 from neuraminidase__InfluenzaA__AFJ78904

SEQ ID NO: 174910 - RNA, 1410 nt, Artificial Sequence; identical to SEQ ID NO: 169258
  derived and/or modified sequence opt4 from neuraminidase__InfluenzaA__AFJ78914

SEQ ID NO: 174911 - RNA, 1410 nt, Artificial Sequence
  derived and/or modified sequence opt4 from neuraminidase__InfluenzaA__AFJ78924
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacguggacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgagauccccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174912 - RNA, 1410 nt, Artificial Sequence
  derived and/or modified sequence opt4 from neuraminidase__InfluenzaA__AFJ97569
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacgagaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugagcuggagcuggcccgacggcgccgagcugcccuucaccaucgacaaguga

SEQ ID NO: 174913 - RNA, 1410 nt, Artificial Sequence; identical to SEQ ID NO: 169248
  derived and/or modified sequence opt4 from neuraminidase__InfluenzaA__AFK14107

SEQ ID NO: 174914 - RNA, 1410 nt, Artificial Sequence; identical to SEQ ID NO: 169258
  derived and/or modified sequence opt4 from neuraminidase__InfluenzaA__AFK14117

SEQ ID NO: 174915 - RNA, 1410 nt, Artificial Sequence; identical to SEQ ID NO: 170025
  derived and/or modified sequence opt4 from neuraminidase__InfluenzaA__AFK14141

SEQ ID NO: 174916 - RNA, 1410 nt, Artificial Sequence
  derived and/or modified sequence opt4 from neuraminidase__InfluenzaA__AFK14150
augaaccccaaccagaagaucaucaccaucggcagcgugugcaugaccaucggcauggccaaccugauccugcagaucggcaacaucaucagcaucuggaucagccacagcaucagacugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacgagcaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174917 - RNA, 1410 nt, Artificial Sequence; identical to SEQ ID NO: 169841
  derived and/or modified sequence opt4 from neuraminidase__InfluenzaA__AFK14159

SEQ ID NO: 174918 - RNA, 1410 nt, Artificial Sequence; identical to SEQ ID NO: 169258
  derived and/or modified sequence opt4 from neuraminidase__InfluenzaA__AFK14168

SEQ ID NO: 174919 - RNA, 1410 nt, Artificial Sequence; identical to SEQ ID NO: 169258
  derived and/or modified sequence opt4 from neuraminidase__InfluenzaA__AFK14177

SEQ ID NO: 174920 - RNA, 1410 nt, Artificial Sequence
  derived and/or modified sequence opt4 from neuraminidase__InfluenzaA__AFK14186
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuucgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174921 - RNA, 1410 nt, Artificial Sequence; identical to SEQ ID NO: 171239
  derived and/or modified sequence opt4 from neuraminidase__InfluenzaA__AFK14195

SEQ ID NO: 174922 - RNA, 1410 nt, Artificial Sequence; identical to SEQ ID NO: 169258
  derived and/or modified sequence opt4 from neuraminidase__InfluenzaA__AFK14204

SEQ ID NO: 174923 - RNA, 1410 nt, Artificial Sequence; identical to SEQ ID NO: 171239
  derived and/or modified sequence opt4 from neuraminidase__InfluenzaA__AFK14213

SEQ ID NO: 174924 - RNA, 1410 nt, Artificial Sequence
  derived and/or modified sequence opt4 from neuraminidase__InfluenzaA__AFK14222
augaaccccaaccagaagaucaucaccaucggcagcgugugcaugaccaucggcauggccaaccugauccugcagaucggcaacaucaucagcaucuggaucagccacagcaucagacugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174925 - RNA, 1410 nt, Artificial Sequence; identical to SEQ ID NO: 169841
  derived and/or modified sequence opt4 from neuraminidase__InfluenzaA__AFK14231

SEQ ID NO: 174926 - RNA, 1410 nt, Artificial Sequence; identical to SEQ ID NO: 169258
  derived and/or modified sequence opt4 from neuraminidase__InfluenzaA__AFK14240

SEQ ID NO: 174927 - RNA, 1410 nt, Artificial Sequence; identical to SEQ ID NO: 170025
  derived and/or modified sequence opt4 from neuraminidase__InfluenzaA__AFK14249

SEQ ID NO: 174928 - RNA, 1410 nt, Artificial Sequence; identical to SEQ ID NO: 169258
  derived and/or modified sequence opt4 from neuraminidase__InfluenzaA__AFK14257

SEQ ID NO: 174929 - RNA, 1410 nt, Artificial Sequence; identical to SEQ ID NO: 169258
  derived and/or modified sequence opt4 from neuraminidase__InfluenzaA__AFK14266

SEQ ID NO: 174930 - RNA, 1410 nt, Artificial Sequence; identical to SEQ ID NO: 169258
  derived and/or modified sequence opt4 from neuraminidase__InfluenzaA__AFK14274

SEQ ID NO: 174931 - RNA, 1410 nt, Artificial Sequence
  derived and/or modified sequence opt4 from neuraminidase__InfluenzaA__AFK14281
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccgacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174932 - RNA, 1410 nt, Artificial Sequence; identical to SEQ ID NO: 169258
  derived and/or modified sequence opt4 from neuraminidase__InfluenzaA__AFK14289

SEQ ID NO: 174933 - RNA, 1410 nt, Artificial Sequence; identical to SEQ ID NO: 169841
  derived and/or modified sequence opt4 from neuraminidase__InfluenzaA__AFK14298

SEQ ID NO: 174934 - RNA, 1410 nt, Artificial Sequence; identical to SEQ ID NO: 169258
  derived and/or modified sequence opt4 from neuraminidase__InfluenzaA__AFK14307

SEQ ID NO: 174935 - RNA, 1410 nt, Artificial Sequence; identical to SEQ ID NO: 171239
  derived and/or modified sequence opt4 from neuraminidase__InfluenzaA__AFK14316

SEQ ID NO: 174936 - RNA, 1410 nt, Artificial Sequence
  derived and/or modified sequence opt4 from neuraminidase__InfluenzaA__AFK14325
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagagaggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174937 - RNA, 1410 nt, Artificial Sequence; identical to SEQ ID NO: 169258
  derived and/or modified sequence opt4 from neuraminidase__InfluenzaA__AFK14334

SEQ ID NO: 174938 - RNA, 1410 nt, Artificial Sequence; identical to SEQ ID NO: 169258
  derived and/or modified sequence opt4 from neuraminidase__InfluenzaA__AFK14343

SEQ ID NO: 174939 - RNA, 1410 nt, Artificial Sequence; identical to SEQ ID NO: 169258
  derived and/or modified sequence opt4 from neuraminidase__InfluenzaA__AFK14352

SEQ ID NO: 174940 - RNA, 1410 nt, Artificial Sequence; identical to SEQ ID NO: 169258
  derived and/or modified sequence opt4 from neuraminidase__InfluenzaA__AFK14360

SEQ ID NO: 174941 - RNA, 1410 nt, Artificial Sequence; identical to SEQ ID NO: 169258
  derived and/or modified sequence opt4 from neuraminidase__InfluenzaA__AFK14369

SEQ ID NO: 174942 - RNA, 1410 nt, Artificial Sequence
  derived and/or modified sequence opt4 from neuraminidase__InfluenzaA__AFK14387
augaaccccaaccagaagaucaucaccaucggcagcgugugcaugaccaucggcauggccaaccugauccugcagaucggcaacaucaccagcaucuggaucagccacagcauccagcugggcaaccagaaccagaucgacaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174943 - RNA, 1410 nt, Artificial Sequence; identical to SEQ ID NO: 169841
  derived and/or modified sequence opt4 from neuraminidase__InfluenzaA__AFK14397

SEQ ID NO: 174944 - RNA, 1410 nt, Artificial Sequence; identical to SEQ ID NO: 169258
  derived and/or modified sequence opt4 from neuraminidase__InfluenzaA__AFK14406

SEQ ID NO: 174945 - RNA, 1410 nt, Artificial Sequence; identical to SEQ ID NO: 169258
  derived and/or modified sequence opt4 from neuraminidase__InfluenzaA__AFK14415

SEQ ID NO: 174946 - RNA, 1410 nt, Artificial Sequence; identical to SEQ ID NO: 169258
  derived and/or modified sequence opt4 from neuraminidase__InfluenzaA__AFK14424

SEQ ID NO: 174947 - RNA, 1410 nt, Artificial Sequence
  derived and/or modified sequence opt4 from neuraminidase__InfluenzaA__AFK14433
augaaccccaaccagaagaucaucaccaucggcagcgugugcaugaucaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174948 - RNA, 1410 nt, Artificial Sequence; identical to SEQ ID NO: 169258
  derived and/or modified sequence opt4 from neuraminidase__InfluenzaA__AFK14442

SEQ ID NO: 174949 - RNA, 1410 nt, Artificial Sequence
  derived and/or modified sequence opt4 from neuraminidase__InfluenzaA__AFK14451
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgccaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 174950 - RNA, 1410 nt, Artificial Sequence; identical to SEQ ID NO: 169258
  derived and/or modified sequence opt4 from neuraminidase__InfluenzaA__AFK14458

SEQ ID NO: 174951 - RNA, 1410 nt, Artificial Sequence; identical to SEQ ID NO: 169258
  derived and/or modified sequence opt4 from neuraminidase__InfluenzaA__AFK14467

SEQ ID NO: 174952 - RNA, 1410 nt, Artificial Sequence; identical to SEQ ID NO: 169258
  derived and/or modified sequence opt4 from neuraminidase__InfluenzaA__AFK14476

SEQ ID NO: 174953 - RNA, 1410 nt, Artificial Sequence; identical to SEQ ID NO: 172317
  derived and/or modified sequence opt4 from neuraminidase__InfluenzaA__AFK14485

SEQ ID NO: 174954 - RNA, 1410 nt, Artificial Sequence; identical to SEQ ID NO: 169258
  derived and/or modified sequence opt4 from neuraminidase__InfluenzaA__AFK14504

SEQ ID NO: 174955 - RNA, 1410 nt, Artificial Sequence; identical to SEQ ID NO: 169258
  derived and/or modified sequence opt4 from neuraminidase__InfluenzaA__AFK14514

SEQ ID NO: 174956 - RNA, 1410 nt, Artificial Sequence; identical to SEQ ID NO: 169258
  derived and/or modified sequence opt4 from neuraminidase__InfluenzaA__AFK14522

SEQ ID NO: 174957 - RNA, 1410 nt, Artificial Sequence; identical to SEQ ID NO: 169258
  derived and/or modified sequence opt4 from neuraminidase__InfluenzaA__AFK14529

SEQ ID NO: 174958 - RNA, 1410 nt, Artificial Sequence; identical to SEQ ID NO: 169258
  derived and/or modified sequence opt4 from neuraminidase__InfluenzaA__AFK14538

SEQ ID NO: 174959 - RNA, 1410 nt, Artificial Sequence; identical to SEQ ID NO: 171633
  derived and/or modified sequence opt4 from neuraminidase__InfluenzaA__AFK14547

SEQ ID NO: 174960 - RNA, 1410 nt, Artificial Sequence
  derived and/or modified sequence opt4 from neuraminidase__InfluenzaA__AFK14555
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcgugaucagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174961 - RNA, 1410 nt, Artificial Sequence; identical to SEQ ID NO: 169258
  derived and/or modified sequence opt4 from neuraminidase__InfluenzaA__AFK14564

SEQ ID NO: 174962 - RNA, 1410 nt, Artificial Sequence; identical to SEQ ID NO: 169258
  derived and/or modified sequence opt4 from neuraminidase__InfluenzaA__AFK14573

SEQ ID NO: 174963 - RNA, 1410 nt, Artificial Sequence
  derived and/or modified sequence opt4 from neuraminidase__InfluenzaA__AFK14579
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaugugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174964 - RNA, 1410 nt, Artificial Sequence; identical to SEQ ID NO: 169258
  derived and/or modified sequence opt4 from neuraminidase__InfluenzaA__AFK14588

SEQ ID NO: 174965 - RNA, 1410 nt, Artificial Sequence; identical to SEQ ID NO: 169258
  derived and/or modified sequence opt4 from neuraminidase__InfluenzaA__AFK14597

SEQ ID NO: 174966 - RNA, 1410 nt, Artificial Sequence; identical to SEQ ID NO: 169258
  derived and/or modified sequence opt4 from neuraminidase__InfluenzaA__AFK14604

SEQ ID NO: 174967 - RNA, 1410 nt, Artificial Sequence; identical to SEQ ID NO: 169258
  derived and/or modified sequence opt4 from neuraminidase__InfluenzaA__AFK14632

SEQ ID NO: 174968 - RNA, 1410 nt, Artificial Sequence; identical to SEQ ID NO: 169248
  derived and/or modified sequence opt4 from neuraminidase__InfluenzaA__AFK14641

SEQ ID NO: 174969 - RNA, 1410 nt, Artificial Sequence; identical to SEQ ID NO: 169258
  derived and/or modified sequence opt4 from neuraminidase__InfluenzaA__AFK14651

SEQ ID NO: 174970 - RNA, 1410 nt, Artificial Sequence; identical to SEQ ID NO: 169258
  derived and/or modified sequence opt4 from neuraminidase__InfluenzaA__AFK14656

SEQ ID NO: 174971 - RNA, 1410 nt, Artificial Sequence; identical to SEQ ID NO: 169258
  derived and/or modified sequence opt4 from neuraminidase__InfluenzaA__AFK14663

SEQ ID NO: 174972 - RNA, 1410 nt, Artificial Sequence; identical to SEQ ID NO: 169258
  derived and/or modified sequence opt4 from neuraminidase__InfluenzaA__AFK14672

SEQ ID NO: 174973 - RNA, 1410 nt, Artificial Sequence; identical to SEQ ID NO: 169258
  derived and/or modified sequence opt4 from neuraminidase__InfluenzaA__AFK14680

SEQ ID NO: 174974 - RNA, 1410 nt, Artificial Sequence; identical to SEQ ID NO: 169258
  derived and/or modified sequence opt4 from neuraminidase__InfluenzaA__AFK14690

SEQ ID NO: 174975 - RNA, 1410 nt, Artificial Sequence; identical to SEQ ID NO: 169258
  derived and/or modified sequence opt4 from neuraminidase__InfluenzaA__AFK14707

SEQ ID NO: 174976 - RNA, 1410 nt, Artificial Sequence; identical to SEQ ID NO: 169258
  derived and/or modified sequence opt4 from neuraminidase__InfluenzaA__AFK14715

SEQ ID NO: 174977 - RNA, 1410 nt, Artificial Sequence; identical to SEQ ID NO: 169258
  derived and/or modified sequence opt4 from neuraminidase__InfluenzaA__AFK14724

SEQ ID NO: 174978 - RNA, 1410 nt, Artificial Sequence; identical to SEQ ID NO: 169258
  derived and/or modified sequence opt4 from neuraminidase__InfluenzaA__AFK14733

SEQ ID NO: 174979 - RNA, 1410 nt, Artificial Sequence; identical to SEQ ID NO: 169258
  derived and/or modified sequence opt4 from neuraminidase__InfluenzaA__AFK14751

SEQ ID NO: 174980 - RNA, 1410 nt, Artificial Sequence; identical to SEQ ID NO: 169258
  derived and/or modified sequence opt4 from neuraminidase__InfluenzaA__AFK14757

SEQ ID NO: 174981 - RNA, 1410 nt, Artificial Sequence; identical to SEQ ID NO: 169258
  derived and/or modified sequence opt4 from neuraminidase__InfluenzaA__AFK14766

SEQ ID NO: 174982 - RNA, 1410 nt, Artificial Sequence; identical to SEQ ID NO: 169841
  derived and/or modified sequence opt4 from neuraminidase__InfluenzaA__AFK14774

SEQ ID NO: 174983 - RNA, 1410 nt, Artificial Sequence; identical to SEQ ID NO: 174960
  derived and/or modified sequence opt4 from neuraminidase__InfluenzaA__AFK14781

SEQ ID NO: 174984 - RNA, 1410 nt, Artificial Sequence; identical to SEQ ID NO: 169841
  derived and/or modified sequence opt4 from neuraminidase__InfluenzaA__AFK14790

SEQ ID NO: 174985 - RNA, 1410 nt, Artificial Sequence
  derived and/or modified sequence opt4 from neuraminidase__InfluenzaA__AFK14800
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccagagagaacaccaucuggaccagcggcagcagcaucagcuucugcggcgugaacagcgacaccgugggcuggagcuggcccgacggcgccgagcugcccuucaccaucgacaaguga

SEQ ID NO: 174986 - RNA, 1410 nt, Artificial Sequence; identical to SEQ ID NO: 171239
  derived and/or modified sequence opt4 from neuraminidase__InfluenzaA__AFK14809

SEQ ID NO: 174987 - RNA, 1410 nt, Artificial Sequence; identical to SEQ ID NO: 171239
  derived and/or modified sequence opt4 from neuraminidase__InfluenzaA__AFK14816

SEQ ID NO: 174988 - RNA, 1410 nt, Artificial Sequence; identical to SEQ ID NO: 169258
  derived and/or modified sequence opt4 from neuraminidase__InfluenzaA__AFK14824

SEQ ID NO: 174989 - RNA, 1410 nt, Artificial Sequence; identical to SEQ ID NO: 169258
  derived and/or modified sequence opt4 from neuraminidase__InfluenzaA__AFK14841

SEQ ID NO: 174990 - RNA, 1410 nt, Artificial Sequence; identical to SEQ ID NO: 170331
  derived and/or modified sequence opt4 from neuraminidase__InfluenzaA__AFK14849

SEQ ID NO: 174991 - RNA, 1410 nt, Artificial Sequence
  derived and/or modified sequence opt4 from neuraminidase__InfluenzaA__AFK14856
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaucgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 174992 - RNA, 1410 nt, Artificial Sequence; identical to SEQ ID NO: 169258
  derived and/or modified sequence opt4 from neuraminidase__InfluenzaA__AFK14870

SEQ ID NO: 174993 - RNA, 1410 nt, Artificial Sequence; identical to SEQ ID NO: 169258
  derived and/or modified sequence opt4 from neuraminidase__InfluenzaA__AFK14879

SEQ ID NO: 174994 - RNA, 1410 nt, Artificial Sequence; identical to SEQ ID NO: 169258
  derived and/or modified sequence opt4 from neuraminidase__InfluenzaA__AFK14885

SEQ ID NO: 174995 - RNA, 1410 nt, Artificial Sequence; identical to SEQ ID NO: 169258
  derived and/or modified sequence opt4 from neuraminidase__InfluenzaA__AFK14894

SEQ ID NO: 174996 - RNA, 1410 nt, Artificial Sequence; identical to SEQ ID NO: 169258
  derived and/or modified sequence opt4 from neuraminidase__InfluenzaA__AFK14903

SEQ ID NO: 174997 - RNA, 1410 nt, Artificial Sequence; identical to SEQ ID NO: 169258
  derived and/or modified sequence opt4 from neuraminidase__InfluenzaA__AFK14912

SEQ ID NO: 174998 - RNA, 1410 nt, Artificial Sequence; identical to SEQ ID NO: 169258
  derived and/or modified sequence opt4 from neuraminidase__InfluenzaA__AFK14921

SEQ ID NO: 174999 - RNA, 1410 nt, Artificial Sequence; identical to SEQ ID NO: 169258
  derived and/or modified sequence opt4 from neuraminidase__InfluenzaA__AFK14931

SEQ ID NO: 175000 - RNA, 1410 nt, Artificial Sequence
  derived and/or modified sequence opt4 from neuraminidase__InfluenzaA__AFK25604
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175001 - RNA, 1410 nt, Artificial Sequence; identical to SEQ ID NO: 175000
  derived and/or modified sequence opt4 from neuraminidase__InfluenzaA__AFK25606

SEQ ID NO: 175002 - RNA, 1410 nt, Artificial Sequence; identical to SEQ ID NO: 170609
  derived and/or modified sequence opt4 from neuraminidase__InfluenzaA__AFK74537

SEQ ID NO: 175003 - RNA, 1410 nt, Artificial Sequence; identical to SEQ ID NO: 169258
  derived and/or modified sequence opt4 from neuraminidase__InfluenzaA__AFK74547

SEQ ID NO: 175004 - RNA, 1410 nt, Artificial Sequence; identical to SEQ ID NO: 172250
  derived and/or modified sequence opt4 from neuraminidase__InfluenzaA__AFK74557

SEQ ID NO: 175005 - RNA, 1410 nt, Artificial Sequence; identical to SEQ ID NO: 169258
  derived and/or modified sequence opt4 from neuraminidase__InfluenzaA__AFK74567

SEQ ID NO: 175006 - RNA, 1410 nt, Artificial Sequence; identical to SEQ ID NO: 169258
  derived and/or modified sequence opt4 from neuraminidase__InfluenzaA__AFK74578

SEQ ID NO: 175007 - RNA, 1410 nt, Artificial Sequence; identical to SEQ ID NO: 174373
  derived and/or modified sequence opt4 from neuraminidase__InfluenzaA__AFK74588

SEQ ID NO: 175008 - RNA, 1410 nt, Artificial Sequence; identical to SEQ ID NO: 169258
  derived and/or modified sequence opt4 from neuraminidase__InfluenzaA__AFK74598

SEQ ID NO: 175009 - RNA, 1410 nt, Artificial Sequence; identical to SEQ ID NO: 169258
  derived and/or modified sequence opt4 from neuraminidase__InfluenzaA__AFK74608

SEQ ID NO: 175010 - RNA, 1410 nt, Artificial Sequence; identical to SEQ ID NO: 169258
  derived and/or modified sequence opt4 from neuraminidase__InfluenzaA__AFK74618

SEQ ID NO: 175011 - RNA, 1410 nt, Artificial Sequence; identical to SEQ ID NO: 169258
  derived and/or modified sequence opt4 from neuraminidase__InfluenzaA__AFK74628

SEQ ID NO: 175012 - RNA, 1410 nt, Artificial Sequence; identical to SEQ ID NO: 169258
  derived and/or modified sequence opt4 from neuraminidase__InfluenzaA__AFK74638

SEQ ID NO: 175013 - RNA, 1410 nt, Artificial Sequence; identical to SEQ ID NO: 169258
  derived and/or modified sequence opt4 from neuraminidase__InfluenzaA__AFK74648

SEQ ID NO: 175014 - RNA, 1410 nt, Artificial Sequence; identical to SEQ ID NO: 174382
  derived and/or modified sequence opt4 from neuraminidase__InfluenzaA__AFK74658

SEQ ID NO: 175015 - RNA, 1410 nt, Artificial Sequence; identical to SEQ ID NO: 174382
  derived and/or modified sequence opt4 from neuraminidase__InfluenzaA__AFK74668

SEQ ID NO: 175016 - RNA, 1410 nt, Artificial Sequence; identical to SEQ ID NO: 169258
  derived and/or modified sequence opt4 from neuraminidase__InfluenzaA__AFK74678

SEQ ID NO: 175017 - RNA, 1410 nt, Artificial Sequence; identical to SEQ ID NO: 169258
  derived and/or modified sequence opt4 from neuraminidase__InfluenzaA__AFK74688

SEQ ID NO: 175018 - RNA, 1410 nt, Artificial Sequence; identical to SEQ ID NO: 169258
  derived and/or modified sequence opt4 from neuraminidase__InfluenzaA__AFK74698

SEQ ID NO: 175019 - RNA, 1410 nt, Artificial Sequence; identical to SEQ ID NO: 174389
  derived and/or modified sequence opt4 from neuraminidase__InfluenzaA__AFK74708

SEQ ID NO: 175020 - RNA, 1410 nt, Artificial Sequence; identical to SEQ ID NO: 172250
  derived and/or modified sequence opt4 from neuraminidase__InfluenzaA__AFK74718

SEQ ID NO: 175021 - RNA, 1410 nt, Artificial Sequence; identical to SEQ ID NO: 169258
  derived and/or modified sequence opt4 from neuraminidase__InfluenzaA__AFK74728

SEQ ID NO: 175022 - RNA, 1410 nt, Artificial Sequence; identical to SEQ ID NO: 169258
  derived and/or modified sequence opt4 from neuraminidase__InfluenzaA__AFK74738

SEQ ID NO: 175023 - RNA, 1410 nt, Artificial Sequence; identical to SEQ ID NO: 169258
  derived and/or modified sequence opt4 from neuraminidase__InfluenzaA__AFK74748

SEQ ID NO: 175024 - RNA, 1410 nt, Artificial Sequence; identical to SEQ ID NO: 169258
  derived and/or modified sequence opt4 from neuraminidase__InfluenzaA__AFK74758

SEQ ID NO: 175025 - RNA, 1410 nt, Artificial Sequence; identical to SEQ ID NO: 169258
  derived and/or modified sequence opt4 from neuraminidase__InfluenzaA__AFK74768

SEQ ID NO: 175026 - RNA, 1410 nt, Artificial Sequence; identical to SEQ ID NO: 169258
  derived and/or modified sequence opt4 from neuraminidase__InfluenzaA__AFK74778

SEQ ID NO: 175027 - RNA, 1410 nt, Artificial Sequence; identical to SEQ ID NO: 172250
  derived and/or modified sequence opt4 from neuraminidase__InfluenzaA__AFK74788

SEQ ID NO: 175028 - RNA, 1410 nt, Artificial Sequence; identical to SEQ ID NO: 172250
  derived and/or modified sequence opt4 from neuraminidase__InfluenzaA__AFK74798

SEQ ID NO: 175029 - RNA, 1410 nt, Artificial Sequence; identical to SEQ ID NO: 172250
  derived and/or modified sequence opt4 from neuraminidase__InfluenzaA__AFK74808

SEQ ID NO: 175030 - RNA, 1410 nt, Artificial Sequence; identical to SEQ ID NO: 172250
  derived and/or modified sequence opt4 from neuraminidase__InfluenzaA__AFK74818

SEQ ID NO: 175031 - RNA, 1410 nt, Artificial Sequence; identical to SEQ ID NO: 169258
  derived and/or modified sequence opt4 from neuraminidase__InfluenzaA__AFK74828

SEQ ID NO: 175032 - RNA, 1410 nt, Artificial Sequence; identical to SEQ ID NO: 171149
  derived and/or modified sequence opt4 from neuraminidase__InfluenzaA__AFK74838

SEQ ID NO: 175033 - RNA, 1410 nt, Artificial Sequence; identical to SEQ ID NO: 169258
  derived and/or modified sequence opt4 from neuraminidase__InfluenzaA__AFK74848

SEQ ID NO: 175034 - RNA, 1410 nt, Artificial Sequence; identical to SEQ ID NO: 169258
  derived and/or modified sequence opt4 from neuraminidase__InfluenzaA__AFK74898

SEQ ID NO: 175035 - RNA, 1410 nt, Artificial Sequence; identical to SEQ ID NO: 169258
  derived and/or modified sequence opt4 from neuraminidase__InfluenzaA__AFK74908

SEQ ID NO: 175036 - RNA, 1410 nt, Artificial Sequence; identical to SEQ ID NO: 169258
  derived and/or modified sequence opt4 from neuraminidase__InfluenzaA__AFK74918

SEQ ID NO: 175037 - RNA, 1410 nt, Artificial Sequence; identical to SEQ ID NO: 169258
  derived and/or modified sequence opt4 from neuraminidase__InfluenzaA__AFK74928

SEQ ID NO: 175038 - RNA, 1410 nt, Artificial Sequence
  derived and/or modified sequence opt4 from neuraminidase__InfluenzaA__AFK74938
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaacaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175039 - RNA, 1410 nt, Artificial Sequence; identical to SEQ ID NO: 169258
  derived and/or modified sequence opt4 from neuraminidase__InfluenzaA__AFK74948

SEQ ID NO: 175040 - RNA, 1410 nt, Artificial Sequence; identical to SEQ ID NO: 171149
  derived and/or modified sequence opt4 from neuraminidase__InfluenzaA__AFK74958

SEQ ID NO: 175041 - RNA, 1410 nt, Artificial Sequence; identical to SEQ ID NO: 172250
  derived and/or modified sequence opt4 from neuraminidase__InfluenzaA__AFK74968

SEQ ID NO: 175042 - RNA, 1410 nt, Artificial Sequence; identical to SEQ ID NO: 169258
  derived and/or modified sequence opt4 from neuraminidase__InfluenzaA__AFK74978

SEQ ID NO: 175043 - RNA, 1410 nt, Artificial Sequence; identical to SEQ ID NO: 171149
  derived and/or modified sequence opt4 from neuraminidase__InfluenzaA__AFK74988

SEQ ID NO: 175044 - RNA, 1410 nt, Artificial Sequence; identical to SEQ ID NO: 169258
  derived and/or modified sequence opt4 from neuraminidase__InfluenzaA__AFK74998

SEQ ID NO: 175045 - RNA, 1410 nt, Artificial Sequence; identical to SEQ ID NO: 172250
  derived and/or modified sequence opt4 from neuraminidase__InfluenzaA__AFK75008

SEQ ID NO: 175046 - RNA, 1410 nt, Artificial Sequence; identical to SEQ ID NO: 169258
  derived and/or modified sequence opt4 from neuraminidase__InfluenzaA__AFK75018

SEQ ID NO: 175047 - RNA, 1410 nt, Artificial Sequence; identical to SEQ ID NO: 169258
  derived and/or modified sequence opt4 from neuraminidase__InfluenzaA__AFK75028

SEQ ID NO: 175048 - RNA, 1410 nt, Artificial Sequence; identical to SEQ ID NO: 169258
  derived and/or modified sequence opt4 from neuraminidase__InfluenzaA__AFK75038

SEQ ID NO: 175049 - RNA, 1410 nt, Artificial Sequence; identical to SEQ ID NO: 169258
  derived and/or modified sequence opt4 from neuraminidase__InfluenzaA__AFK75048

SEQ ID NO: 175050 - RNA, 1410 nt, Artificial Sequence; identical to SEQ ID NO: 169258
  derived and/or modified sequence opt4 from neuraminidase__InfluenzaA__AFK75058

SEQ ID NO: 175051 - RNA, 1410 nt, Artificial Sequence; identical to SEQ ID NO: 172250
  derived and/or modified sequence opt4 from neuraminidase__InfluenzaA__AFK75068

SEQ ID NO: 175052 - RNA, 1410 nt, Artificial Sequence; identical to SEQ ID NO: 169258
  derived and/or modified sequence opt4 from neuraminidase__InfluenzaA__AFK75078

SEQ ID NO: 175053 - RNA, 1410 nt, Artificial Sequence; identical to SEQ ID NO: 169258
  derived and/or modified sequence opt4 from neuraminidase__InfluenzaA__AFK75088

SEQ ID NO: 175054 - RNA, 1410 nt, Artificial Sequence; identical to SEQ ID NO: 169258
  derived and/or modified sequence opt4 from neuraminidase__InfluenzaA__AFK75098

SEQ ID NO: 175055 - RNA, 1410 nt, Artificial Sequence; identical to SEQ ID NO: 171171
  derived and/or modified sequence opt4 from neuraminidase__InfluenzaA__AFK75108

SEQ ID NO: 175056 - RNA, 1410 nt, Artificial Sequence; identical to SEQ ID NO: 169258
  derived and/or modified sequence opt4 from neuraminidase__InfluenzaA__AFK77860

SEQ ID NO: 175057 - RNA, 1410 nt, Artificial Sequence; identical to SEQ ID NO: 169258
  derived and/or modified sequence opt4 from neuraminidase__InfluenzaA__AFK77870

SEQ ID NO: 175058 - RNA, 1410 nt, Artificial Sequence; identical to SEQ ID NO: 169258
  derived and/or modified sequence opt4 from neuraminidase__InfluenzaA__AFK77880

SEQ ID NO: 175059 - RNA, 1410 nt, Artificial Sequence
  derived and/or modified sequence opt4 from neuraminidase__InfluenzaA__AFK77890
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagggcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175060 - RNA, 1410 nt, Artificial Sequence
  derived and/or modified sequence opt4 from neuraminidase__InfluenzaA__AFK77900
augaaccccaaccagaagaucaucaccaucggcagcgugugcaugaccaucggcauggccaaccugauccugcagaucggcaacaucaucagcaucuggaucagccacagcauccagaucggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagagcccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175061 - RNA, 1410 nt, Artificial Sequence
  derived and/or modified sequence opt4 from neuraminidase__InfluenzaA__AFK78031
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagagcccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175062 - RNA, 1410 nt, Artificial Sequence; identical to SEQ ID NO: 169258
  derived and/or modified sequence opt4 from neuraminidase__InfluenzaA__AFK78190

SEQ ID NO: 175063 - RNA, 1362 nt, Artificial Sequence
  derived and/or modified sequence opt4 from neuraminidase__InfluenzaA__AFM68957
augaaccccaaccagaagaucaucaccaucggcagcaucugcaugguggugggcaucaucagccugauccugcagaucggcaacaucaucagcaucuggaucagccacagcauccagaccggcaaccagaaccacaccggcaucugcaaccagggcaucaucacccacaacgugguggccggccaggacagcaccagcgugauccugaccggcaacagcagccugugccccaucagaggcugggccauccacagcaaggacaacggcaucagaaucggcagcaagggcgacguguucgugaucagagagcccuucaucagcugcagccaccuggagugcagaaccuucuuccugacccagggcgcccugcugaacgacaagcacagcuacggcaccagcaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcaccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccgugagcgccgacggcgccaacggcgugaagggcuucagcuacagauacggcaacggcguguggaucggcagaaccaagagcgacagcagcagacacggcuucgagaugaucugggaccccaacggcuggaccgagaccgacagcagauucagcgugagacaggacgugguggccaugaccgacagaagcggcuacagcggcagcuucgugcagcaccccgagcugaccggccuggacugcaugagacccugcuucuggguggagcugaucagaggccagcccgaggaggagaccaucuggaccagcggcagcaucaucagcuucugcggcgugaacagcgacaccguggacuggagcuggcccgacggcgccgagcugcccuucaccaucgacaaguga

SEQ ID NO: 175064 - RNA, 1410 nt, Artificial Sequence
  derived and/or modified sequence opt4 from neuraminidase__InfluenzaA__AFM68968
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgccagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 175065 - RNA, 1410 nt, Artificial Sequence
  derived and/or modified sequence opt4 from neuraminidase__InfluenzaA__AFM68979
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcggcaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 175066 - RNA, 1410 nt, Artificial Sequence; identical to SEQ ID NO: 175065
  derived and/or modified sequence opt4 from neuraminidase__InfluenzaA__AFM68990

SEQ ID NO: 175067 - RNA, 1410 nt, Artificial Sequence; identical to SEQ ID NO: 167333
  derived and/or modified sequence opt4 from neuraminidase__InfluenzaA__AFM71723

SEQ ID NO: 175068 - RNA, 1410 nt, Artificial Sequence; identical to SEQ ID NO: 174655
  derived and/or modified sequence opt4 from neuraminidase__InfluenzaA__AFM71734

SEQ ID NO: 175069 - RNA, 1410 nt, Artificial Sequence; identical to SEQ ID NO: 174469
  derived and/or modified sequence opt4 from neuraminidase__InfluenzaA__AFM71745

SEQ ID NO: 175070 - RNA, 1410 nt, Artificial Sequence; identical to SEQ ID NO: 171129
  derived and/or modified sequence opt4 from neuraminidase__InfluenzaA__AFM71771

SEQ ID NO: 175071 - RNA, 1410 nt, Artificial Sequence; identical to SEQ ID NO: 174155
  derived and/or modified sequence opt4 from neuraminidase__InfluenzaA__AFM71782

SEQ ID NO: 175072 - RNA, 1410 nt, Artificial Sequence; identical to SEQ ID NO: 174155
  derived and/or modified sequence opt4 from neuraminidase__InfluenzaA__AFM71794

SEQ ID NO: 175073 - RNA, 1410 nt, Artificial Sequence; identical to SEQ ID NO: 169119
  derived and/or modified sequence opt4 from neuraminidase__InfluenzaA__AFM71805

SEQ ID NO: 175074 - RNA, 1410 nt, Artificial Sequence
  derived and/or modified sequence opt4 from neuraminidase__InfluenzaA__AFM71827
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaaggacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175075 - RNA, 1410 nt, Artificial Sequence; identical to SEQ ID NO: 172038
  derived and/or modified sequence opt4 from neuraminidase__InfluenzaA__AFM71838

SEQ ID NO: 175076 - RNA, 1365 nt, Artificial Sequence; identical to SEQ ID NO: 168239
  derived and/or modified sequence opt4 from neuraminidase__InfluenzaA__AFM71849

SEQ ID NO: 175077 - RNA, 1410 nt, Artificial Sequence; identical to SEQ ID NO: 166615
  derived and/or modified sequence opt4 from neuraminidase__InfluenzaA__AFM71860

SEQ ID NO: 175078 - RNA, 1410 nt, Artificial Sequence; identical to SEQ ID NO: 166847
  derived and/or modified sequence opt4 from neuraminidase__InfluenzaA__AFM71871

SEQ ID NO: 175079 - RNA, 1410 nt, Artificial Sequence; identical to SEQ ID NO: 166847
  derived and/or modified sequence opt4 from neuraminidase__InfluenzaA__AFM71882

SEQ ID NO: 175080 - RNA, 1410 nt, Artificial Sequence
  derived and/or modified sequence opt4 from neuraminidase__InfluenzaA__AFM71893
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggagagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 175081 - RNA, 1410 nt, Artificial Sequence
  derived and/or modified sequence opt4 from neuraminidase__InfluenzaA__AFM71904
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgugaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcggcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggagagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 175082 - RNA, 1410 nt, Artificial Sequence; identical to SEQ ID NO: 167492
  derived and/or modified sequence opt4 from neuraminidase__InfluenzaA__AFM71915

SEQ ID NO: 175083 - RNA, 1410 nt, Artificial Sequence; identical to SEQ ID NO: 167492
  derived and/or modified sequence opt4 from neuraminidase__InfluenzaA__AFM71926

SEQ ID NO: 175084 - RNA, 1410 nt, Artificial Sequence; identical to SEQ ID NO: 167492
  derived and/or modified sequence opt4 from neuraminidase__InfluenzaA__AFM71937

SEQ ID NO: 175085 - RNA, 1410 nt, Artificial Sequence; identical to SEQ ID NO: 174500
  derived and/or modified sequence opt4 from neuraminidase__InfluenzaA__AFM71948

SEQ ID NO: 175086 - RNA, 1410 nt, Artificial Sequence; identical to SEQ ID NO: 174500
  derived and/or modified sequence opt4 from neuraminidase__InfluenzaA__AFM71959

SEQ ID NO: 175087 - RNA, 1410 nt, Artificial Sequence
  derived and/or modified sequence opt4 from neuraminidase__InfluenzaA__AFM71970
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccuacgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggagaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgccaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 175088 - RNA, 1410 nt, Artificial Sequence; identical to SEQ ID NO: 174508
  derived and/or modified sequence opt4 from neuraminidase__InfluenzaA__AFM71981

SEQ ID NO: 175089 - RNA, 1410 nt, Artificial Sequence
  derived and/or modified sequence opt4 from neuraminidase__InfluenzaA__AFM71992
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagccaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175090 - RNA, 1410 nt, Artificial Sequence; identical to SEQ ID NO: 175064
  derived and/or modified sequence opt4 from neuraminidase__InfluenzaA__AFM72013

SEQ ID NO: 175091 - RNA, 1365 nt, Artificial Sequence; identical to SEQ ID NO: 168239
  derived and/or modified sequence opt4 from neuraminidase__InfluenzaA__AFM72024

SEQ ID NO: 175092 - RNA, 1410 nt, Artificial Sequence; identical to SEQ ID NO: 171515
  derived and/or modified sequence opt4 from neuraminidase__InfluenzaA__AFM72035

SEQ ID NO: 175093 - RNA, 1410 nt, Artificial Sequence; identical to SEQ ID NO: 171515
  derived and/or modified sequence opt4 from neuraminidase__InfluenzaA__AFM72046

SEQ ID NO: 175094 - RNA, 1413 nt, Artificial Sequence
  derived and/or modified sequence opt4 from neuraminidase__InfluenzaA__AFM72057
augaaccccaaccagaagaucaucaccaucggcagcaucugcaccaccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaccaccagcgugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 175095 - RNA, 1413 nt, Artificial Sequence; identical to SEQ ID NO: 167579
  derived and/or modified sequence opt4 from neuraminidase__InfluenzaA__AFM72068

SEQ ID NO: 175096 - RNA, 1410 nt, Artificial Sequence
  derived and/or modified sequence opt4 from neuraminidase__InfluenzaA__AFM72090
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucggcgaggagcugagacugggcuacgagaccuucaaggugaucggcggcuggagcacccccaacagcaagcugcagaucaacagacaggugaucguggacagcaagaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 175097 - RNA, 1410 nt, Artificial Sequence
  derived and/or modified sequence opt4 from neuraminidase__InfluenzaA__AFM72101
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggccaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 175098 - RNA, 1410 nt, Artificial Sequence; identical to SEQ ID NO: 167333
  derived and/or modified sequence opt4 from neuraminidase__InfluenzaA__AFM72112

SEQ ID NO: 175099 - RNA, 1410 nt, Artificial Sequence
  derived and/or modified sequence opt4 from neuraminidase__InfluenzaA__AFM72123
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaccaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 175100 - RNA, 1410 nt, Artificial Sequence; identical to SEQ ID NO: 174655
  derived and/or modified sequence opt4 from neuraminidase__InfluenzaA__AFM72134

SEQ ID NO: 175101 - RNA, 1410 nt, Artificial Sequence
  derived and/or modified sequence opt4 from neuraminidase__InfluenzaA__AFM72145
augaaccccaaccagaagaucaucaccaucggcagcgugagccugaccaucgccaccaucugcuuccugaugcagaucgccauccuggccaucaccgugacccugcacuucaagcaguacgagugcaacagcccccccaacaaccaggugaugcugugcgagcccaccaucaucgagagaaacaccaccgagaucguguaccugaccaacaccaccaucgagaaggaggugugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 175102 - RNA, 1410 nt, Artificial Sequence; identical to SEQ ID NO: 167705
  derived and/or modified sequence opt4 from neuraminidase__InfluenzaA__AFM72156

SEQ ID NO: 175103 - RNA, 1410 nt, Artificial Sequence
  derived and/or modified sequence opt4 from neuraminidase__InfluenzaA__AFM72167
augaaccccaaccagaagaucaucaccaucggcagcaucagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccgagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 175104 - RNA, 1410 nt, Artificial Sequence
  derived and/or modified sequence opt4 from neuraminidase__InfluenzaA__AFM72178
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccgagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcuggaaccccaacaacgagaagggcggccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 175105 - RNA, 1410 nt, Artificial Sequence
  derived and/or modified sequence opt4 from neuraminidase__InfluenzaA__AFM72189
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugcugggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcgacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 175106 - RNA, 1410 nt, Artificial Sequence; identical to SEQ ID NO: 175105
  derived and/or modified sequence opt4 from neuraminidase__InfluenzaA__AFM72200

SEQ ID NO: 175107 - RNA, 1410 nt, Artificial Sequence; identical to SEQ ID NO: 168269
  derived and/or modified sequence opt4 from neuraminidase__InfluenzaA__AFM72211

SEQ ID NO: 175108 - RNA, 1410 nt, Artificial Sequence; identical to SEQ ID NO: 168269
  derived and/or modified sequence opt4 from neuraminidase__InfluenzaA__AFM72222

SEQ ID NO: 175109 - RNA, 1413 nt, Artificial Sequence; identical to SEQ ID NO: 168973
  derived and/or modified sequence opt4 from neuraminidase__InfluenzaA__AFM72233

SEQ ID NO: 175110 - RNA, 1410 nt, Artificial Sequence; identical to SEQ ID NO: 167093
  derived and/or modified sequence opt4 from neuraminidase__InfluenzaA__AFM72249

SEQ ID NO: 175111 - RNA, 1410 nt, Artificial Sequence; identical to SEQ ID NO: 166581
  derived and/or modified sequence opt4 from neuraminidase__InfluenzaA__AFM72260

SEQ ID NO: 175112 - RNA, 1410 nt, Artificial Sequence; identical to SEQ ID NO: 166581
  derived and/or modified sequence opt4 from neuraminidase__InfluenzaA__AFM72271

SEQ ID NO: 175113 - RNA, 1410 nt, Artificial Sequence
  derived and/or modified sequence opt4 from neuraminidase__InfluenzaA__AFM72293
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacuacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 175114 - RNA, 1410 nt, Artificial Sequence; identical to SEQ ID NO: 168449
  derived and/or modified sequence opt4 from neuraminidase__InfluenzaA__AFM72304

SEQ ID NO: 175115 - RNA, 1410 nt, Artificial Sequence
  derived and/or modified sequence opt4 from neuraminidase__InfluenzaA__AFM72315
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgagaagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 175116 - RNA, 1410 nt, Artificial Sequence
  derived and/or modified sequence opt4 from neuraminidase__InfluenzaA__AFM72326
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaaguuccagaucaacagacaggugaucguggacagagacaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 175117 - RNA, 1410 nt, Artificial Sequence
  derived and/or modified sequence opt4 from neuraminidase__InfluenzaA__AFM72337
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175118 - RNA, 1410 nt, Artificial Sequence
  derived and/or modified sequence opt4 from neuraminidase__InfluenzaA__AFM72348
augaaccccaaccagaagaucaucaccaucggcagcgugagccugaccaucgccaccaucugcuuccugaugcagaucgccauccuggugaccaccgugacccugcacuucaagcagcacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcauccccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 175119 - RNA, 1410 nt, Artificial Sequence
  derived and/or modified sequence opt4 from neuraminidase__InfluenzaA__AFM72359
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgacaucaaccugaugcccaucuga

SEQ ID NO: 175120 - RNA, 1410 nt, Artificial Sequence; identical to SEQ ID NO: 175119
  derived and/or modified sequence opt4 from neuraminidase__InfluenzaA__AFM72370

SEQ ID NO: 175121 - RNA, 1410 nt, Artificial Sequence; identical to SEQ ID NO: 172038
  derived and/or modified sequence opt4 from neuraminidase__InfluenzaA__AFM72381

SEQ ID NO: 175122 - RNA, 1410 nt, Artificial Sequence; identical to SEQ ID NO: 172038
  derived and/or modified sequence opt4 from neuraminidase__InfluenzaA__AFM72392

SEQ ID NO: 175123 - RNA, 1410 nt, Artificial Sequence; identical to SEQ ID NO: 168922
  derived and/or modified sequence opt4 from neuraminidase__InfluenzaA__AFM72403

SEQ ID NO: 175124 - RNA, 1410 nt, Artificial Sequence; identical to SEQ ID NO: 168922
  derived and/or modified sequence opt4 from neuraminidase__InfluenzaA__AFM72414

SEQ ID NO: 175125 - RNA, 1410 nt, Artificial Sequence; identical to SEQ ID NO: 168586
  derived and/or modified sequence opt4 from neuraminidase__InfluenzaA__AFM72425

SEQ ID NO: 175126 - RNA, 1410 nt, Artificial Sequence; identical to SEQ ID NO: 168586
  derived and/or modified sequence opt4 from neuraminidase__InfluenzaA__AFM72436

SEQ ID NO: 175127 - RNA, 1410 nt, Artificial Sequence; identical to SEQ ID NO: 168586
  derived and/or modified sequence opt4 from neuraminidase__InfluenzaA__AFM72447

SEQ ID NO: 175128 - RNA, 1410 nt, Artificial Sequence; identical to SEQ ID NO: 168586
  derived and/or modified sequence opt4 from neuraminidase__InfluenzaA__AFM72458

SEQ ID NO: 175129 - RNA, 1410 nt, Artificial Sequence; identical to SEQ ID NO: 168586
  derived and/or modified sequence opt4 from neuraminidase__InfluenzaA__AFM72469

SEQ ID NO: 175130 - RNA, 1410 nt, Artificial Sequence
  derived and/or modified sequence opt4 from neuraminidase__InfluenzaA__AFM72491
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugaugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175131 - RNA, 1410 nt, Artificial Sequence; identical to SEQ ID NO: 175130
  derived and/or modified sequence opt4 from neuraminidase__InfluenzaA__AFM72502

SEQ ID NO: 175132 - RNA, 1413 nt, Artificial Sequence; identical to SEQ ID NO: 169152
  derived and/or modified sequence opt4 from neuraminidase__InfluenzaA__AFM72513

SEQ ID NO: 175133 - RNA, 1413 nt, Artificial Sequence; identical to SEQ ID NO: 169152
  derived and/or modified sequence opt4 from neuraminidase__InfluenzaA__AFM72524

SEQ ID NO: 175134 - RNA, 1413 nt, Artificial Sequence; identical to SEQ ID NO: 169152
  derived and/or modified sequence opt4 from neuraminidase__InfluenzaA__AFM72535

SEQ ID NO: 175135 - RNA, 1413 nt, Artificial Sequence; identical to SEQ ID NO: 169152
  derived and/or modified sequence opt4 from neuraminidase__InfluenzaA__AFM72546

SEQ ID NO: 175136 - RNA, 1413 nt, Artificial Sequence; identical to SEQ ID NO: 169152
  derived and/or modified sequence opt4 from neuraminidase__InfluenzaA__AFM72557

SEQ ID NO: 175137 - RNA, 1410 nt, Artificial Sequence
  derived and/or modified sequence opt4 from neuraminidase__InfluenzaA__AFM72579
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcauccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175138 - RNA, 1413 nt, Artificial Sequence
  derived and/or modified sequence opt4 from neuraminidase__InfluenzaA__AFM72802
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaugugcaaccagagaaucaucaccuacgagaacagcaccugggugaaccacaccuacgugaacaucaacaacaccaacgugguggccggcaaggacaagacccccgugacccuggccggcaacagcagccugugcagcaucagcggcugggccauccacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaucaagagcauggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagaaucagaaagggcuucgagaugaucugggaccccaacggcuggaccaacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaucgccaacuggagcuggcccgacggcgccgagcugcccuucaccaucgacaaguga

SEQ ID NO: 175139 - RNA, 1413 nt, Artificial Sequence; identical to SEQ ID NO: 175138
  derived and/or modified sequence opt4 from neuraminidase__InfluenzaA__AFM72813

SEQ ID NO: 175140 - RNA, 1413 nt, Artificial Sequence; identical to SEQ ID NO: 175138
  derived and/or modified sequence opt4 from neuraminidase__InfluenzaA__AFM72824

SEQ ID NO: 175141 - RNA, 1410 nt, Artificial Sequence; identical to SEQ ID NO: 169248
  derived and/or modified sequence opt4 from neuraminidase__InfluenzaA__AFM72835

SEQ ID NO: 175142 - RNA, 1410 nt, Artificial Sequence; identical to SEQ ID NO: 169248
  derived and/or modified sequence opt4 from neuraminidase__InfluenzaA__AFM72845

SEQ ID NO: 175143 - RNA, 1410 nt, Artificial Sequence; identical to SEQ ID NO: 169248
  derived and/or modified sequence opt4 from neuraminidase__InfluenzaA__AFM72855

SEQ ID NO: 175144 - RNA, 1410 nt, Artificial Sequence; identical to SEQ ID NO: 169248
  derived and/or modified sequence opt4 from neuraminidase__InfluenzaA__AFM72865

SEQ ID NO: 175145 - RNA, 1410 nt, Artificial Sequence
  derived and/or modified sequence opt4 from neuraminidase__InfluenzaA__AFM72875
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagagcgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 175146 - RNA, 1410 nt, Artificial Sequence; identical to SEQ ID NO: 169119
  derived and/or modified sequence opt4 from neuraminidase__InfluenzaA__AFM72886

SEQ ID NO: 175147 - RNA, 1410 nt, Artificial Sequence; identical to SEQ ID NO: 169119
  derived and/or modified sequence opt4 from neuraminidase__InfluenzaA__AFM72897

SEQ ID NO: 175148 - RNA, 1410 nt, Artificial Sequence
  derived and/or modified sequence opt4 from neuraminidase__InfluenzaA__AFM72908
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaccaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 175149 - RNA, 1410 nt, Artificial Sequence
  derived and/or modified sequence opt4 from neuraminidase__InfluenzaA__AFM72919
augaaccccaaccagaagaucaucaccaucggcagcgugagccugaccaucagcaccaucugcuucuucaugcagaucgccauccugaucaccaccgugacccugcacuucaagcagcacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaccaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccguguga

SEQ ID NO: 175150 - RNA, 1410 nt, Artificial Sequence; identical to SEQ ID NO: 170425
  derived and/or modified sequence opt4 from neuraminidase__InfluenzaA__AFM72930

SEQ ID NO: 175151 - RNA, 1410 nt, Artificial Sequence; identical to SEQ ID NO: 170425
  derived and/or modified sequence opt4 from neuraminidase__InfluenzaA__AFM72941

SEQ ID NO: 175152 - RNA, 1410 nt, Artificial Sequence; identical to SEQ ID NO: 170425
  derived and/or modified sequence opt4 from neuraminidase__InfluenzaA__AFM72952

SEQ ID NO: 175153 - RNA, 1410 nt, Artificial Sequence; identical to SEQ ID NO: 170425
  derived and/or modified sequence opt4 from neuraminidase__InfluenzaA__AFM72963

SEQ ID NO: 175154 - RNA, 1410 nt, Artificial Sequence; identical to SEQ ID NO: 170425
  derived and/or modified sequence opt4 from neuraminidase__InfluenzaA__AFM72974

SEQ ID NO: 175155 - RNA, 1410 nt, Artificial Sequence; identical to SEQ ID NO: 172038
  derived and/or modified sequence opt4 from neuraminidase__InfluenzaA__AFM72985

SEQ ID NO: 175156 - RNA, 1410 nt, Artificial Sequence; identical to SEQ ID NO: 172038
  derived and/or modified sequence opt4 from neuraminidase__InfluenzaA__AFM72996

SEQ ID NO: 175157 - RNA, 1410 nt, Artificial Sequence; identical to SEQ ID NO: 172038
  derived and/or modified sequence opt4 from neuraminidase__InfluenzaA__AFM73007

SEQ ID NO: 175158 - RNA, 1410 nt, Artificial Sequence
  derived and/or modified sequence opt4 from neuraminidase__InfluenzaA__AFM73018
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcaucuggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175159 - RNA, 1410 nt, Artificial Sequence; identical to SEQ ID NO: 175158
  derived and/or modified sequence opt4 from neuraminidase__InfluenzaA__AFM73028

SEQ ID NO: 175160 - RNA, 1410 nt, Artificial Sequence; identical to SEQ ID NO: 175158
  derived and/or modified sequence opt4 from neuraminidase__InfluenzaA__AFM73038

SEQ ID NO: 175161 - RNA, 1410 nt, Artificial Sequence; identical to SEQ ID NO: 170993
  derived and/or modified sequence opt4 from neuraminidase__InfluenzaA__AFM73048

SEQ ID NO: 175162 - RNA, 1410 nt, Artificial Sequence
  derived and/or modified sequence opt4 from neuraminidase__InfluenzaA__AFM73058
augaaccccaaccagaagaucaucaccaucggcagcuucugcaugaccaucggccuggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaagaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175163 - RNA, 1410 nt, Artificial Sequence; identical to SEQ ID NO: 170993
  derived and/or modified sequence opt4 from neuraminidase__InfluenzaA__AFM73068

SEQ ID NO: 175164 - RNA, 1413 nt, Artificial Sequence; identical to SEQ ID NO: 167471
  derived and/or modified sequence opt4 from neuraminidase__InfluenzaA__AFM73480

SEQ ID NO: 175165 - RNA, 1350 nt, Artificial Sequence
  derived and/or modified sequence opt4 from neuraminidase__InfluenzaA__AFM78569
augaaccccaaccagaagaucaucaccaucggcagcaucugcauggugaucggcaucgugagccugaugcugcagaucggcaacaugaucagcaucugggugauccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacgacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 175166 - RNA, 1410 nt, Artificial Sequence
  derived and/or modified sequence opt4 from neuraminidase__InfluenzaA__AFM85180
augaaccccaaccagaagaucaucaccaucggcagcgugagccugaccaucgccaccaucugcuuccugacccagaucgccauccuggugaccaccgugacccugcacuucaagcaguacgagugcaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgaggugcuguggaccagcaacagcaucgugguguucugcggcaccagcggcaccuacggcaccggcagcuggcccgacggcgccgacaucaaccugaugcccaucuga

SEQ ID NO: 175167 - RNA, 1410 nt, Artificial Sequence; identical to SEQ ID NO: 166623
  derived and/or modified sequence opt4 from neuraminidase__InfluenzaA__AFN11830

SEQ ID NO: 175168 - RNA, 1410 nt, Artificial Sequence
  derived and/or modified sequence opt4 from neuraminidase__InfluenzaA__AFN11831
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaacaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 175169 - RNA, 1410 nt, Artificial Sequence; identical to SEQ ID NO: 167096
  derived and/or modified sequence opt4 from neuraminidase__InfluenzaA__AFN11833

SEQ ID NO: 175170 - RNA, 1410 nt, Artificial Sequence; identical to SEQ ID NO: 169031
  derived and/or modified sequence opt4 from neuraminidase__InfluenzaA__AFN11835

SEQ ID NO: 175171 - RNA, 1410 nt, Artificial Sequence
  derived and/or modified sequence opt4 from neuraminidase__InfluenzaA__AFN11836
augaaccccaaccagaagaucaucaccaucggcagcgugagccugaccaucgccaccaugugcuuccugaugcagaucgccauccuggugaccaccgugacccugcacuucaagcaguacgagugcagcagcccccccaacaaccaggugaugcccugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucauccacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagaagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 175172 - RNA, 1410 nt, Artificial Sequence
  derived and/or modified sequence opt4 from neuraminidase__InfluenzaA__AFN11839
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugccagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacaugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcacccccaacagcaagcugcagaucaacagacaggugaucguggacagcggcaacagaagcggcuacagcggcaucuucagcguggagggcaagagcugcaucaacagaugcuucuacguggagcugaucagaggcagaaagcaggagaccaaggugugguggaccagcaacagcaucgugguguucugcggcaccagcggcaccuacggcaccggcagcuggcccgacggcgccgacaucaaccugaugcccaucuga

SEQ ID NO: 175173 - RNA, 1410 nt, Artificial Sequence
  derived and/or modified sequence opt4 from neuraminidase__InfluenzaA__AFN11840
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagaggcaacagaagcggcuacagcggcaucuucagcguggagggcaagagcugcaucaacagaugcuucuacguggagcuggugagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 175174 - RNA, 1410 nt, Artificial Sequence; identical to SEQ ID NO: 168449
  derived and/or modified sequence opt4 from neuraminidase__InfluenzaA__AFN11841

SEQ ID NO: 175175 - RNA, 1410 nt, Artificial Sequence; identical to SEQ ID NO: 174537
  derived and/or modified sequence opt4 from neuraminidase__InfluenzaA__AFN11842

SEQ ID NO: 175176 - RNA, 1410 nt, Artificial Sequence
  derived and/or modified sequence opt4 from neuraminidase__InfluenzaA__AFN11844
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucggccugaugcccauguga

SEQ ID NO: 175177 - RNA, 1410 nt, Artificial Sequence; identical to SEQ ID NO: 175096
  derived and/or modified sequence opt4 from neuraminidase__InfluenzaA__AFN11845

SEQ ID NO: 175178 - RNA, 1410 nt, Artificial Sequence; identical to SEQ ID NO: 174624
  derived and/or modified sequence opt4 from neuraminidase__InfluenzaA__AFN11847

SEQ ID NO: 175179 - RNA, 1410 nt, Artificial Sequence
  derived and/or modified sequence opt4 from neuraminidase__InfluenzaA__AFN11848
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccugggccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 175180 - RNA, 1410 nt, Artificial Sequence
  derived and/or modified sequence opt4 from neuraminidase__InfluenzaA__AFN11850
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175181 - RNA, 1410 nt, Artificial Sequence
  derived and/or modified sequence opt4 from neuraminidase__InfluenzaA__AFN11851
augaaccccaaccagaagaucaucaccaucggcagcgugagccugaccaucgccaccaucugccugcugaugcagaucgccauccuggugaccaccgugacccugcacuucaagcaguacgagugcaacagcccccccaacaaccaggugaugcugugcgagcccaccaucaucgagagaaacaucaccaagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgagagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagcuacugcagaaaccccaacaacgagaagggcagccacggcgugaagggcugggccuucgacgacggcaacgacguguggaugggcagaaccaucagcgaggagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 175182 - RNA, 1410 nt, Artificial Sequence; identical to SEQ ID NO: 166847
  derived and/or modified sequence opt4 from neuraminidase__InfluenzaA__AFN11853

SEQ ID NO: 175183 - RNA, 1410 nt, Artificial Sequence
  derived and/or modified sequence opt4 from neuraminidase__InfluenzaA__AFN11855
augaaccccaaccagaagaucaucaccaucggcagcgugagccugaccaucagcaccaucugcuucuucaugcagaccgccauccugaucaccaucgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcauccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175184 - RNA, 1410 nt, Artificial Sequence; identical to SEQ ID NO: 168449
  derived and/or modified sequence opt4 from neuraminidase__InfluenzaA__AFN11857

SEQ ID NO: 175185 - RNA, 1410 nt, Artificial Sequence; identical to SEQ ID NO: 169258
  derived and/or modified sequence opt4 from neuraminidase__InfluenzaA__AFN17373

SEQ ID NO: 175186 - RNA, 1410 nt, Artificial Sequence; identical to SEQ ID NO: 174891
  derived and/or modified sequence opt4 from neuraminidase__InfluenzaA__AFN17383

SEQ ID NO: 175187 - RNA, 1410 nt, Artificial Sequence; identical to SEQ ID NO: 169258
  derived and/or modified sequence opt4 from neuraminidase__InfluenzaA__AFN17393

SEQ ID NO: 175188 - RNA, 1410 nt, Artificial Sequence; identical to SEQ ID NO: 169258
  derived and/or modified sequence opt4 from neuraminidase__InfluenzaA__AFN17403

SEQ ID NO: 175189 - RNA, 1410 nt, Artificial Sequence; identical to SEQ ID NO: 169258
  derived and/or modified sequence opt4 from neuraminidase__InfluenzaA__AFN17413

SEQ ID NO: 175190 - RNA, 1410 nt, Artificial Sequence; identical to SEQ ID NO: 169258
  derived and/or modified sequence opt4 from neuraminidase__InfluenzaA__AFN17423

SEQ ID NO: 175191 - RNA, 1410 nt, Artificial Sequence; identical to SEQ ID NO: 169258
  derived and/or modified sequence opt4 from neuraminidase__InfluenzaA__AFN17433

SEQ ID NO: 175192 - RNA, 1410 nt, Artificial Sequence; identical to SEQ ID NO: 169258
  derived and/or modified sequence opt4 from neuraminidase__InfluenzaA__AFN17443

SEQ ID NO: 175193 - RNA, 1410 nt, Artificial Sequence; identical to SEQ ID NO: 169258
  derived and/or modified sequence opt4 from neuraminidase__InfluenzaA__AFN17453

SEQ ID NO: 175194 - RNA, 1410 nt, Artificial Sequence; identical to SEQ ID NO: 169258
  derived and/or modified sequence opt4 from neuraminidase__InfluenzaA__AFN17459

SEQ ID NO: 175195 - RNA, 1410 nt, Artificial Sequence; identical to SEQ ID NO: 169258
  derived and/or modified sequence opt4 from neuraminidase__InfluenzaA__AFN17469

SEQ ID NO: 175196 - RNA, 1410 nt, Artificial Sequence; identical to SEQ ID NO: 169258
  derived and/or modified sequence opt4 from neuraminidase__InfluenzaA__AFN17479

SEQ ID NO: 175197 - RNA, 1410 nt, Artificial Sequence; identical to SEQ ID NO: 169258
  derived and/or modified sequence opt4 from neuraminidase__InfluenzaA__AFN17489

SEQ ID NO: 175198 - RNA, 1410 nt, Artificial Sequence; identical to SEQ ID NO: 169258
  derived and/or modified sequence opt4 from neuraminidase__InfluenzaA__AFN17499

SEQ ID NO: 175199 - RNA, 1410 nt, Artificial Sequence; identical to SEQ ID NO: 169258
  derived and/or modified sequence opt4 from neuraminidase__InfluenzaA__AFN17509

SEQ ID NO: 175200 - RNA, 1410 nt, Artificial Sequence; identical to SEQ ID NO: 169258
  derived and/or modified sequence opt4 from neuraminidase__InfluenzaA__AFN17519

SEQ ID NO: 175201 - RNA, 1410 nt, Artificial Sequence; identical to SEQ ID NO: 169258
  derived and/or modified sequence opt4 from neuraminidase__InfluenzaA__AFN17529

SEQ ID NO: 175202 - RNA, 1410 nt, Artificial Sequence; identical to SEQ ID NO: 169258
  derived and/or modified sequence opt4 from neuraminidase__InfluenzaA__AFN17539

SEQ ID NO: 175203 - RNA, 1410 nt, Artificial Sequence; identical to SEQ ID NO: 169258
  derived and/or modified sequence opt4 from neuraminidase__InfluenzaA__AFN17549

SEQ ID NO: 175204 - RNA, 1410 nt, Artificial Sequence; identical to SEQ ID NO: 169258
  derived and/or modified sequence opt4 from neuraminidase__InfluenzaA__AFN17559

SEQ ID NO: 175205 - RNA, 1410 nt, Artificial Sequence; identical to SEQ ID NO: 169258
  derived and/or modified sequence opt4 from neuraminidase__InfluenzaA__AFN17569

SEQ ID NO: 175206 - RNA, 1410 nt, Artificial Sequence; identical to SEQ ID NO: 169258
  derived and/or modified sequence opt4 from neuraminidase__InfluenzaA__AFN17575

SEQ ID NO: 175207 - RNA, 1410 nt, Artificial Sequence; identical to SEQ ID NO: 169258
  derived and/or modified sequence opt4 from neuraminidase__InfluenzaA__AFN17581

SEQ ID NO: 175208 - RNA, 1410 nt, Artificial Sequence; identical to SEQ ID NO: 169258
  derived and/or modified sequence opt4 from neuraminidase__InfluenzaA__AFN17587

SEQ ID NO: 175209 - RNA, 1410 nt, Artificial Sequence; identical to SEQ ID NO: 169258
  derived and/or modified sequence opt4 from neuraminidase__InfluenzaA__AFN17597

SEQ ID NO: 175210 - RNA, 1410 nt, Artificial Sequence; identical to SEQ ID NO: 174891
  derived and/or modified sequence opt4 from neuraminidase__InfluenzaA__AFN17607

SEQ ID NO: 175211 - RNA, 1410 nt, Artificial Sequence; identical to SEQ ID NO: 169258
  derived and/or modified sequence opt4 from neuraminidase__InfluenzaA__AFN17617

SEQ ID NO: 175212 - RNA, 1410 nt, Artificial Sequence; identical to SEQ ID NO: 169258
  derived and/or modified sequence opt4 from neuraminidase__InfluenzaA__AFN17627

SEQ ID NO: 175213 - RNA, 1410 nt, Artificial Sequence; identical to SEQ ID NO: 169258
  derived and/or modified sequence opt4 from neuraminidase__InfluenzaA__AFN17637

SEQ ID NO: 175214 - RNA, 1410 nt, Artificial Sequence; identical to SEQ ID NO: 169258
  derived and/or modified sequence opt4 from neuraminidase__InfluenzaA__AFN17647

SEQ ID NO: 175215 - RNA, 1410 nt, Artificial Sequence; identical to SEQ ID NO: 169258
  derived and/or modified sequence opt4 from neuraminidase__InfluenzaA__AFN17657

SEQ ID NO: 175216 - RNA, 1410 nt, Artificial Sequence; identical to SEQ ID NO: 169258
  derived and/or modified sequence opt4 from neuraminidase__InfluenzaA__AFN17667

SEQ ID NO: 175217 - RNA, 1410 nt, Artificial Sequence; identical to SEQ ID NO: 169258
  derived and/or modified sequence opt4 from neuraminidase__InfluenzaA__AFN17677

SEQ ID NO: 175218 - RNA, 1410 nt, Artificial Sequence; identical to SEQ ID NO: 174891
  derived and/or modified sequence opt4 from neuraminidase__InfluenzaA__AFN17687

SEQ ID NO: 175219 - RNA, 1410 nt, Artificial Sequence; identical to SEQ ID NO: 169258
  derived and/or modified sequence opt4 from neuraminidase__InfluenzaA__AFN17697

SEQ ID NO: 175220 - RNA, 1410 nt, Artificial Sequence; identical to SEQ ID NO: 174891
  derived and/or modified sequence opt4 from neuraminidase__InfluenzaA__AFN17707

SEQ ID NO: 175221 - RNA, 1410 nt, Artificial Sequence; identical to SEQ ID NO: 169258
  derived and/or modified sequence opt4 from neuraminidase__InfluenzaA__AFN17717

SEQ ID NO: 175222 - RNA, 1410 nt, Artificial Sequence; identical to SEQ ID NO: 174891
  derived and/or modified sequence opt4 from neuraminidase__InfluenzaA__AFN17727

SEQ ID NO: 175223 - RNA, 1410 nt, Artificial Sequence; identical to SEQ ID NO: 169258
  derived and/or modified sequence opt4 from neuraminidase__InfluenzaA__AFN17737

SEQ ID NO: 175224 - RNA, 1410 nt, Artificial Sequence; identical to SEQ ID NO: 169258
  derived and/or modified sequence opt4 from neuraminidase__InfluenzaA__AFN17743

SEQ ID NO: 175225 - RNA, 1410 nt, Artificial Sequence; identical to SEQ ID NO: 174891
  derived and/or modified sequence opt4 from neuraminidase__InfluenzaA__AFN17749

SEQ ID NO: 175226 - RNA, 1410 nt, Artificial Sequence; identical to SEQ ID NO: 169258
  derived and/or modified sequence opt4 from neuraminidase__InfluenzaA__AFN17759

SEQ ID NO: 175227 - RNA, 1410 nt, Artificial Sequence; identical to SEQ ID NO: 169258
  derived and/or modified sequence opt4 from neuraminidase__InfluenzaA__AFN17769

SEQ ID NO: 175228 - RNA, 1410 nt, Artificial Sequence; identical to SEQ ID NO: 169258
  derived and/or modified sequence opt4 from neuraminidase__InfluenzaA__AFN17775

SEQ ID NO: 175229 - RNA, 1410 nt, Artificial Sequence
  derived and/or modified sequence opt4 from neuraminidase__InfluenzaA__AFN17785
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaccuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175230 - RNA, 1410 nt, Artificial Sequence
  derived and/or modified sequence opt4 from neuraminidase__InfluenzaA__AFN17795
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugggcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175231 - RNA, 1410 nt, Artificial Sequence; identical to SEQ ID NO: 169258
  derived and/or modified sequence opt4 from neuraminidase__InfluenzaA__AFN17805

SEQ ID NO: 175232 - RNA, 1410 nt, Artificial Sequence
  derived and/or modified sequence opt4 from neuraminidase__InfluenzaA__AFN17815
augaaccccaaccagaagaucaucaccaucggcagcgugagcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175233 - RNA, 1410 nt, Artificial Sequence; identical to SEQ ID NO: 169258
  derived and/or modified sequence opt4 from neuraminidase__InfluenzaA__AFN17825

SEQ ID NO: 175234 - RNA, 1410 nt, Artificial Sequence; identical to SEQ ID NO: 174891
  derived and/or modified sequence opt4 from neuraminidase__InfluenzaA__AFN17835

SEQ ID NO: 175235 - RNA, 1410 nt, Artificial Sequence; identical to SEQ ID NO: 169258
  derived and/or modified sequence opt4 from neuraminidase__InfluenzaA__AFN17845

SEQ ID NO: 175236 - RNA, 1410 nt, Artificial Sequence; identical to SEQ ID NO: 169258
  derived and/or modified sequence opt4 from neuraminidase__InfluenzaA__AFN17855

SEQ ID NO: 175237 - RNA, 1410 nt, Artificial Sequence; identical to SEQ ID NO: 171072
  derived and/or modified sequence opt4 from neuraminidase__InfluenzaA__AFN17865

SEQ ID NO: 175238 - RNA, 1410 nt, Artificial Sequence; identical to SEQ ID NO: 174891
  derived and/or modified sequence opt4 from neuraminidase__InfluenzaA__AFN17875

SEQ ID NO: 175239 - RNA, 1410 nt, Artificial Sequence; identical to SEQ ID NO: 174891
  derived and/or modified sequence opt4 from neuraminidase__InfluenzaA__AFN17885

SEQ ID NO: 175240 - RNA, 1410 nt, Artificial Sequence; identical to SEQ ID NO: 169258
  derived and/or modified sequence opt4 from neuraminidase__InfluenzaA__AFN17895

SEQ ID NO: 175241 - RNA, 1410 nt, Artificial Sequence; identical to SEQ ID NO: 174891
  derived and/or modified sequence opt4 from neuraminidase__InfluenzaA__AFN17905

SEQ ID NO: 175242 - RNA, 1410 nt, Artificial Sequence; identical to SEQ ID NO: 169258
  derived and/or modified sequence opt4 from neuraminidase__InfluenzaA__AFN17911

SEQ ID NO: 175243 - RNA, 1410 nt, Artificial Sequence; identical to SEQ ID NO: 174891
  derived and/or modified sequence opt4 from neuraminidase__InfluenzaA__AFN17921

SEQ ID NO: 175244 - RNA, 1410 nt, Artificial Sequence
  derived and/or modified sequence opt4 from neuraminidase__InfluenzaA__AFN17931
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcagaggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175245 - RNA, 1410 nt, Artificial Sequence; identical to SEQ ID NO: 169258
  derived and/or modified sequence opt4 from neuraminidase__InfluenzaA__AFN17941

SEQ ID NO: 175246 - RNA, 1410 nt, Artificial Sequence; identical to SEQ ID NO: 169258
  derived and/or modified sequence opt4 from neuraminidase__InfluenzaA__AFN17951

SEQ ID NO: 175247 - RNA, 1410 nt, Artificial Sequence
  derived and/or modified sequence opt4 from neuraminidase__InfluenzaA__AFN17961
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaacagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175248 - RNA, 1410 nt, Artificial Sequence; identical to SEQ ID NO: 169258
  derived and/or modified sequence opt4 from neuraminidase__InfluenzaA__AFN17971

SEQ ID NO: 175249 - RNA, 1410 nt, Artificial Sequence; identical to SEQ ID NO: 169258
  derived and/or modified sequence opt4 from neuraminidase__InfluenzaA__AFN17981

SEQ ID NO: 175250 - RNA, 1410 nt, Artificial Sequence; identical to SEQ ID NO: 169258
  derived and/or modified sequence opt4 from neuraminidase__InfluenzaA__AFN17991

SEQ ID NO: 175251 - RNA, 1410 nt, Artificial Sequence
  derived and/or modified sequence opt4 from neuraminidase__InfluenzaA__AFN18001
augaaccccaaccagaagaucaucaccaucagcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175252 - RNA, 1410 nt, Artificial Sequence; identical to SEQ ID NO: 169258
  derived and/or modified sequence opt4 from neuraminidase__InfluenzaA__AFN18011

SEQ ID NO: 175253 - RNA, 1410 nt, Artificial Sequence; identical to SEQ ID NO: 169258
  derived and/or modified sequence opt4 from neuraminidase__InfluenzaA__AFN18021

SEQ ID NO: 175254 - RNA, 1410 nt, Artificial Sequence
  derived and/or modified sequence opt4 from neuraminidase__InfluenzaA__AFN18031
augaaccccaaccagaagaucaucaccaucggcagcaucugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175255 - RNA, 1410 nt, Artificial Sequence; identical to SEQ ID NO: 169258
  derived and/or modified sequence opt4 from neuraminidase__InfluenzaA__AFN18041

SEQ ID NO: 175256 - RNA, 1410 nt, Artificial Sequence; identical to SEQ ID NO: 174891
  derived and/or modified sequence opt4 from neuraminidase__InfluenzaA__AFN18051

SEQ ID NO: 175257 - RNA, 1410 nt, Artificial Sequence; identical to SEQ ID NO: 174891
  derived and/or modified sequence opt4 from neuraminidase__InfluenzaA__AFN18061

SEQ ID NO: 175258 - RNA, 1410 nt, Artificial Sequence; identical to SEQ ID NO: 169258
  derived and/or modified sequence opt4 from neuraminidase__InfluenzaA__AFN18070

SEQ ID NO: 175259 - RNA, 1410 nt, Artificial Sequence; identical to SEQ ID NO: 169258
  derived and/or modified sequence opt4 from neuraminidase__InfluenzaA__AFN18080

SEQ ID NO: 175260 - RNA, 1410 nt, Artificial Sequence; identical to SEQ ID NO: 169258
  derived and/or modified sequence opt4 from neuraminidase__InfluenzaA__AFN18090

SEQ ID NO: 175261 - RNA, 1410 nt, Artificial Sequence; identical to SEQ ID NO: 169258
  derived and/or modified sequence opt4 from neuraminidase__InfluenzaA__AFN18100

SEQ ID NO: 175262 - RNA, 1410 nt, Artificial Sequence; identical to SEQ ID NO: 169258
  derived and/or modified sequence opt4 from neuraminidase__InfluenzaA__AFN18106

SEQ ID NO: 175263 - RNA, 1410 nt, Artificial Sequence
  derived and/or modified sequence opt4 from neuraminidase__InfluenzaA__AFN18108
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugcugagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175264 - RNA, 1410 nt, Artificial Sequence
  derived and/or modified sequence opt4 from neuraminidase__InfluenzaA__AFN18118
augaaccccaaccagaagaucaucaccaucggcagcgugugcaugaccaucggcauggccaaccugauccugcagaucggcaacaugaucagcaucuggaucagccacagcauccagcugggcaaccagaaccagaucgagaccugcaaccagagcgugaucaccuacgagaacaacaccugggugaaccagaccuacgugaagaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175265 - RNA, 1410 nt, Artificial Sequence; identical to SEQ ID NO: 169258
  derived and/or modified sequence opt4 from neuraminidase__InfluenzaA__AFN18120

SEQ ID NO: 175266 - RNA, 1410 nt, Artificial Sequence; identical to SEQ ID NO: 169258
  derived and/or modified sequence opt4 from neuraminidase__InfluenzaA__AFN18122

SEQ ID NO: 175267 - RNA, 1410 nt, Artificial Sequence; identical to SEQ ID NO: 174891
  derived and/or modified sequence opt4 from neuraminidase__InfluenzaA__AFN18128

SEQ ID NO: 175268 - RNA, 1410 nt, Artificial Sequence; identical to SEQ ID NO: 174891
  derived and/or modified sequence opt4 from neuraminidase__InfluenzaA__AFN18134

SEQ ID NO: 175269 - RNA, 1410 nt, Artificial Sequence; identical to SEQ ID NO: 169258
  derived and/or modified sequence opt4 from neuraminidase__InfluenzaA__AFN18136

SEQ ID NO: 175270 - RNA, 1410 nt, Artificial Sequence; identical to SEQ ID NO: 169258
  derived and/or modified sequence opt4 from neuraminidase__InfluenzaA__AFN18138

SEQ ID NO: 175271 - RNA, 1410 nt, Artificial Sequence
  derived and/or modified sequence opt4 from neuraminidase__InfluenzaA__AFN18140
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcaucuggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175272 - RNA, 1410 nt, Artificial Sequence; identical to SEQ ID NO: 169258
  derived and/or modified sequence opt4 from neuraminidase__InfluenzaA__AFN18144

SEQ ID NO: 175273 - RNA, 1410 nt, Artificial Sequence; identical to SEQ ID NO: 169258
  derived and/or modified sequence opt4 from neuraminidase__InfluenzaA__AFN18150

SEQ ID NO: 175274 - RNA, 1410 nt, Artificial Sequence; identical to SEQ ID NO: 169258
  derived and/or modified sequence opt4 from neuraminidase__InfluenzaA__AFN18156

SEQ ID NO: 175275 - RNA, 1410 nt, Artificial Sequence; identical to SEQ ID NO: 169258
  derived and/or modified sequence opt4 from neuraminidase__InfluenzaA__AFN18158

SEQ ID NO: 175276 - RNA, 1410 nt, Artificial Sequence; identical to SEQ ID NO: 171072
  derived and/or modified sequence opt4 from neuraminidase__InfluenzaA__AFN18160

SEQ ID NO: 175277 - RNA, 1410 nt, Artificial Sequence
  derived and/or modified sequence opt4 from neuraminidase__InfluenzaA__AFN18166
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaagaccugggugaaccagaccuacgugaacaucagcaacgccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcaaguucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175278 - RNA, 1410 nt, Artificial Sequence; identical to SEQ ID NO: 169258
  derived and/or modified sequence opt4 from neuraminidase__InfluenzaA__AFN18172

SEQ ID NO: 175279 - RNA, 1410 nt, Artificial Sequence; identical to SEQ ID NO: 170276
  derived and/or modified sequence opt4 from neuraminidase__InfluenzaA__AFN18178

SEQ ID NO: 175280 - RNA, 1410 nt, Artificial Sequence
  derived and/or modified sequence opt4 from neuraminidase__InfluenzaA__AFN18184
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcauggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175281 - RNA, 1410 nt, Artificial Sequence; identical to SEQ ID NO: 172250
  derived and/or modified sequence opt4 from neuraminidase__InfluenzaA__AFN18190

SEQ ID NO: 175282 - RNA, 1410 nt, Artificial Sequence; identical to SEQ ID NO: 173271
  derived and/or modified sequence opt4 from neuraminidase__InfluenzaA__AFN18196

SEQ ID NO: 175283 - RNA, 1410 nt, Artificial Sequence
  derived and/or modified sequence opt4 from neuraminidase__InfluenzaA__AFN18202
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggcagaagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175284 - RNA, 1410 nt, Artificial Sequence; identical to SEQ ID NO: 169258
  derived and/or modified sequence opt4 from neuraminidase__InfluenzaA__AFN18208

SEQ ID NO: 175285 - RNA, 1410 nt, Artificial Sequence
  derived and/or modified sequence opt4 from neuraminidase__InfluenzaA__AFN18210
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagagccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacugaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175286 - RNA, 1410 nt, Artificial Sequence; identical to SEQ ID NO: 169841
  derived and/or modified sequence opt4 from neuraminidase__InfluenzaA__AFN18216

SEQ ID NO: 175287 - RNA, 1410 nt, Artificial Sequence; identical to SEQ ID NO: 171587
  derived and/or modified sequence opt4 from neuraminidase__InfluenzaA__AFN18226

SEQ ID NO: 175288 - RNA, 1410 nt, Artificial Sequence; identical to SEQ ID NO: 169258
  derived and/or modified sequence opt4 from neuraminidase__InfluenzaA__AFN18232

SEQ ID NO: 175289 - RNA, 1410 nt, Artificial Sequence; identical to SEQ ID NO: 169258
  derived and/or modified sequence opt4 from neuraminidase__InfluenzaA__AFN18234

SEQ ID NO: 175290 - RNA, 1410 nt, Artificial Sequence; identical to SEQ ID NO: 169258
  derived and/or modified sequence opt4 from neuraminidase__InfluenzaA__AFN18244

SEQ ID NO: 175291 - RNA, 1410 nt, Artificial Sequence; identical to SEQ ID NO: 169258
  derived and/or modified sequence opt4 from neuraminidase__InfluenzaA__AFN18246

SEQ ID NO: 175292 - RNA, 1410 nt, Artificial Sequence; identical to SEQ ID NO: 171587
  derived and/or modified sequence opt4 from neuraminidase__InfluenzaA__AFN18256

SEQ ID NO: 175293 - RNA, 1410 nt, Artificial Sequence; identical to SEQ ID NO: 169258
  derived and/or modified sequence opt4 from neuraminidase__InfluenzaA__AFN18262

SEQ ID NO: 175294 - RNA, 1410 nt, Artificial Sequence; identical to SEQ ID NO: 169258
  derived and/or modified sequence opt4 from neuraminidase__InfluenzaA__AFN18268

SEQ ID NO: 175295 - RNA, 1410 nt, Artificial Sequence; identical to SEQ ID NO: 169258
  derived and/or modified sequence opt4 from neuraminidase__InfluenzaA__AFN18270

SEQ ID NO: 175296 - RNA, 1410 nt, Artificial Sequence; identical to SEQ ID NO: 172247
  derived and/or modified sequence opt4 from neuraminidase__InfluenzaA__AFN18272

SEQ ID NO: 175297 - RNA, 1410 nt, Artificial Sequence; identical to SEQ ID NO: 169258
  derived and/or modified sequence opt4 from neuraminidase__InfluenzaA__AFN18274

SEQ ID NO: 175298 - RNA, 1410 nt, Artificial Sequence; identical to SEQ ID NO: 169258
  derived and/or modified sequence opt4 from neuraminidase__InfluenzaA__AFN18282

SEQ ID NO: 175299 - RNA, 1410 nt, Artificial Sequence; identical to SEQ ID NO: 169258
  derived and/or modified sequence opt4 from neuraminidase__InfluenzaA__AFN18304

SEQ ID NO: 175300 - RNA, 1410 nt, Artificial Sequence
  derived and/or modified sequence opt4 from neuraminidase__InfluenzaA__AFN18306
augaaccccaaccagaagaucaucaccaucggcagcgugugcaugaccaucggcaucgccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175301 - RNA, 1410 nt, Artificial Sequence
  derived and/or modified sequence opt4 from neuraminidase__InfluenzaA__AFN18308
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaagggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175302 - RNA, 1410 nt, Artificial Sequence
  derived and/or modified sequence opt4 from neuraminidase__InfluenzaA__AFN18314
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaagaccaucuggaccagcggcagcagcaucagcuucugcggcgugaacagcgacaccgugggcuggagcuggcccgacggcgccgagcugcccuucaccaucgacaaguga

SEQ ID NO: 175303 - RNA, 1410 nt, Artificial Sequence; identical to SEQ ID NO: 169258
  derived and/or modified sequence opt4 from neuraminidase__InfluenzaA__AFN18320

SEQ ID NO: 175304 - RNA, 1410 nt, Artificial Sequence
  derived and/or modified sequence opt4 from neuraminidase__InfluenzaA__AFN18326
augaaccccaaccagaagaucaucaccaucggcagcgugugcaugaccaucggcauggccaaccugcugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175305 - RNA, 1410 nt, Artificial Sequence; identical to SEQ ID NO: 169258
  derived and/or modified sequence opt4 from neuraminidase__InfluenzaA__AFN18336

SEQ ID NO: 175306 - RNA, 1410 nt, Artificial Sequence; identical to SEQ ID NO: 169258
  derived and/or modified sequence opt4 from neuraminidase__InfluenzaA__AFN18346

SEQ ID NO: 175307 - RNA, 1410 nt, Artificial Sequence; identical to SEQ ID NO: 174891
  derived and/or modified sequence opt4 from neuraminidase__InfluenzaA__AFN18356

SEQ ID NO: 175308 - RNA, 1410 nt, Artificial Sequence
  derived and/or modified sequence opt4 from neuraminidase__InfluenzaA__AFN18366
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccgagcagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgaggugaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175309 - RNA, 1410 nt, Artificial Sequence; identical to SEQ ID NO: 174891
  derived and/or modified sequence opt4 from neuraminidase__InfluenzaA__AFN18376

SEQ ID NO: 175310 - RNA, 1410 nt, Artificial Sequence; identical to SEQ ID NO: 169258
  derived and/or modified sequence opt4 from neuraminidase__InfluenzaA__AFN18382

SEQ ID NO: 175311 - RNA, 1410 nt, Artificial Sequence; identical to SEQ ID NO: 169258
  derived and/or modified sequence opt4 from neuraminidase__InfluenzaA__AFN18392

SEQ ID NO: 175312 - RNA, 1410 nt, Artificial Sequence; identical to SEQ ID NO: 169258
  derived and/or modified sequence opt4 from neuraminidase__InfluenzaA__AFN18402

SEQ ID NO: 175313 - RNA, 1410 nt, Artificial Sequence; identical to SEQ ID NO: 169258
  derived and/or modified sequence opt4 from neuraminidase__InfluenzaA__AFN18412

SEQ ID NO: 175314 - RNA, 1410 nt, Artificial Sequence; identical to SEQ ID NO: 169258
  derived and/or modified sequence opt4 from neuraminidase__InfluenzaA__AFN18422

SEQ ID NO: 175315 - RNA, 1410 nt, Artificial Sequence; identical to SEQ ID NO: 169258
  derived and/or modified sequence opt4 from neuraminidase__InfluenzaA__AFN18432

SEQ ID NO: 175316 - RNA, 1410 nt, Artificial Sequence; identical to SEQ ID NO: 169258
  derived and/or modified sequence opt4 from neuraminidase__InfluenzaA__AFN18442

SEQ ID NO: 175317 - RNA, 1410 nt, Artificial Sequence; identical to SEQ ID NO: 169258
  derived and/or modified sequence opt4 from neuraminidase__InfluenzaA__AFN18452

SEQ ID NO: 175318 - RNA, 1410 nt, Artificial Sequence; identical to SEQ ID NO: 169258
  derived and/or modified sequence opt4 from neuraminidase__InfluenzaA__AFN18462

SEQ ID NO: 175319 - RNA, 1410 nt, Artificial Sequence
  derived and/or modified sequence opt4 from neuraminidase__InfluenzaA__AFN18472
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaagggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175320 - RNA, 1410 nt, Artificial Sequence; identical to SEQ ID NO: 169258
  derived and/or modified sequence opt4 from neuraminidase__InfluenzaA__AFN18482

SEQ ID NO: 175321 - RNA, 1410 nt, Artificial Sequence; identical to SEQ ID NO: 169258
  derived and/or modified sequence opt4 from neuraminidase__InfluenzaA__AFN18492

SEQ ID NO: 175322 - RNA, 1410 nt, Artificial Sequence
  derived and/or modified sequence opt4 from neuraminidase__InfluenzaA__AFN18514
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175323 - RNA, 1410 nt, Artificial Sequence
  derived and/or modified sequence opt4 from neuraminidase__InfluenzaA__AFN18520
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcgugaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175324 - RNA, 1410 nt, Artificial Sequence; identical to SEQ ID NO: 169258
  derived and/or modified sequence opt4 from neuraminidase__InfluenzaA__AFN18522

SEQ ID NO: 175325 - RNA, 1410 nt, Artificial Sequence; identical to SEQ ID NO: 169258
  derived and/or modified sequence opt4 from neuraminidase__InfluenzaA__AFN18524

SEQ ID NO: 175326 - RNA, 1410 nt, Artificial Sequence; identical to SEQ ID NO: 174891
  derived and/or modified sequence opt4 from neuraminidase__InfluenzaA__AFN18530

SEQ ID NO: 175327 - RNA, 1410 nt, Artificial Sequence; identical to SEQ ID NO: 169258
  derived and/or modified sequence opt4 from neuraminidase__InfluenzaA__AFN18532

SEQ ID NO: 175328 - RNA, 1410 nt, Artificial Sequence; identical to SEQ ID NO: 169258
  derived and/or modified sequence opt4 from neuraminidase__InfluenzaA__AFN18538

SEQ ID NO: 175329 - RNA, 1410 nt, Artificial Sequence; identical to SEQ ID NO: 169258
  derived and/or modified sequence opt4 from neuraminidase__InfluenzaA__AFN18544

SEQ ID NO: 175330 - RNA, 1410 nt, Artificial Sequence; identical to SEQ ID NO: 169258
  derived and/or modified sequence opt4 from neuraminidase__InfluenzaA__AFN18546

SEQ ID NO: 175331 - RNA, 1410 nt, Artificial Sequence; identical to SEQ ID NO: 169258
  derived and/or modified sequence opt4 from neuraminidase__InfluenzaA__AFN18552

SEQ ID NO: 175332 - RNA, 1410 nt, Artificial Sequence; identical to SEQ ID NO: 169258
  derived and/or modified sequence opt4 from neuraminidase__InfluenzaA__AFN18558

SEQ ID NO: 175333 - RNA, 1410 nt, Artificial Sequence; identical to SEQ ID NO: 169258
  derived and/or modified sequence opt4 from neuraminidase__InfluenzaA__AFN18560

SEQ ID NO: 175334 - RNA, 1410 nt, Artificial Sequence; identical to SEQ ID NO: 169258
  derived and/or modified sequence opt4 from neuraminidase__InfluenzaA__AFN18562

SEQ ID NO: 175335 - RNA, 1410 nt, Artificial Sequence; identical to SEQ ID NO: 169258
  derived and/or modified sequence opt4 from neuraminidase__InfluenzaA__AFN18564

SEQ ID NO: 175336 - RNA, 1410 nt, Artificial Sequence; identical to SEQ ID NO: 169258
  derived and/or modified sequence opt4 from neuraminidase__InfluenzaA__AFN18566

SEQ ID NO: 175337 - RNA, 1410 nt, Artificial Sequence; identical to SEQ ID NO: 169258
  derived and/or modified sequence opt4 from neuraminidase__InfluenzaA__AFN18572

SEQ ID NO: 175338 - RNA, 1410 nt, Artificial Sequence; identical to SEQ ID NO: 169258
  derived and/or modified sequence opt4 from neuraminidase__InfluenzaA__AFN18582

SEQ ID NO: 175339 - RNA, 1410 nt, Artificial Sequence; identical to SEQ ID NO: 169258
  derived and/or modified sequence opt4 from neuraminidase__InfluenzaA__AFN18592

SEQ ID NO: 175340 - RNA, 1410 nt, Artificial Sequence; identical to SEQ ID NO: 174891
  derived and/or modified sequence opt4 from neuraminidase__InfluenzaA__AFN18602

SEQ ID NO: 175341 - RNA, 1410 nt, Artificial Sequence
  derived and/or modified sequence opt4 from neuraminidase__InfluenzaA__AFN18612
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175342 - RNA, 1410 nt, Artificial Sequence; identical to SEQ ID NO: 169258
  derived and/or modified sequence opt4 from neuraminidase__InfluenzaA__AFN18618

SEQ ID NO: 175343 - RNA, 1410 nt, Artificial Sequence; identical to SEQ ID NO: 170084
  derived and/or modified sequence opt4 from neuraminidase__InfluenzaA__AFN18624

SEQ ID NO: 175344 - RNA, 1410 nt, Artificial Sequence
  derived and/or modified sequence opt4 from neuraminidase__InfluenzaA__AFN18630
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccugggcugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175345 - RNA, 1410 nt, Artificial Sequence
  derived and/or modified sequence opt4 from neuraminidase__InfluenzaA__AFN18636
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagaagcaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175346 - RNA, 1410 nt, Artificial Sequence; identical to SEQ ID NO: 169258
  derived and/or modified sequence opt4 from neuraminidase__InfluenzaA__AFN18646

SEQ ID NO: 175347 - RNA, 1410 nt, Artificial Sequence; identical to SEQ ID NO: 169258
  derived and/or modified sequence opt4 from neuraminidase__InfluenzaA__AFN18656

SEQ ID NO: 175348 - RNA, 1410 nt, Artificial Sequence
  derived and/or modified sequence opt4 from neuraminidase__InfluenzaA__AFN18666
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaucaucgacaaguga

SEQ ID NO: 175349 - RNA, 1410 nt, Artificial Sequence
  derived and/or modified sequence opt4 from neuraminidase__InfluenzaA__AFN18676
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175350 - RNA, 1410 nt, Artificial Sequence
  derived and/or modified sequence opt4 from neuraminidase__InfluenzaA__AFN18686
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcagcaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175351 - RNA, 1410 nt, Artificial Sequence; identical to SEQ ID NO: 169258
  derived and/or modified sequence opt4 from neuraminidase__InfluenzaA__AFN18696

SEQ ID NO: 175352 - RNA, 1410 nt, Artificial Sequence; identical to SEQ ID NO: 171845
  derived and/or modified sequence opt4 from neuraminidase__InfluenzaA__AFN18706

SEQ ID NO: 175353 - RNA, 1410 nt, Artificial Sequence; identical to SEQ ID NO: 169258
  derived and/or modified sequence opt4 from neuraminidase__InfluenzaA__AFN18716

SEQ ID NO: 175354 - RNA, 1410 nt, Artificial Sequence; identical to SEQ ID NO: 169258
  derived and/or modified sequence opt4 from neuraminidase__InfluenzaA__AFN18727

SEQ ID NO: 175355 - RNA, 1410 nt, Artificial Sequence
  derived and/or modified sequence opt4 from neuraminidase__InfluenzaA__AFN18737
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagauggugugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175356 - RNA, 1410 nt, Artificial Sequence; identical to SEQ ID NO: 169258
  derived and/or modified sequence opt4 from neuraminidase__InfluenzaA__AFN18743

SEQ ID NO: 175357 - RNA, 1410 nt, Artificial Sequence; identical to SEQ ID NO: 169258
  derived and/or modified sequence opt4 from neuraminidase__InfluenzaA__AFN18749

SEQ ID NO: 175358 - RNA, 1410 nt, Artificial Sequence; identical to SEQ ID NO: 169258
  derived and/or modified sequence opt4 from neuraminidase__InfluenzaA__AFN18759

SEQ ID NO: 175359 - RNA, 1410 nt, Artificial Sequence
  derived and/or modified sequence opt4 from neuraminidase__InfluenzaA__AFN18769
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcaacgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175360 - RNA, 1410 nt, Artificial Sequence; identical to SEQ ID NO: 171160
  derived and/or modified sequence opt4 from neuraminidase__InfluenzaA__AFN18775

SEQ ID NO: 175361 - RNA, 1410 nt, Artificial Sequence; identical to SEQ ID NO: 169258
  derived and/or modified sequence opt4 from neuraminidase__InfluenzaA__AFN18777

SEQ ID NO: 175362 - RNA, 1410 nt, Artificial Sequence; identical to SEQ ID NO: 169258
  derived and/or modified sequence opt4 from neuraminidase__InfluenzaA__AFN18779

SEQ ID NO: 175363 - RNA, 1410 nt, Artificial Sequence
  derived and/or modified sequence opt4 from neuraminidase__InfluenzaA__AFN18785
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucagacaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175364 - RNA, 1410 nt, Artificial Sequence
  derived and/or modified sequence opt4 from neuraminidase__InfluenzaA__AFN18791
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgagagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175365 - RNA, 1410 nt, Artificial Sequence; identical to SEQ ID NO: 169258
  derived and/or modified sequence opt4 from neuraminidase__InfluenzaA__AFN18801

SEQ ID NO: 175366 - RNA, 1410 nt, Artificial Sequence; identical to SEQ ID NO: 171677
  derived and/or modified sequence opt4 from neuraminidase__InfluenzaA__AFN18811

SEQ ID NO: 175367 - RNA, 1410 nt, Artificial Sequence; identical to SEQ ID NO: 169258
  derived and/or modified sequence opt4 from neuraminidase__InfluenzaA__AFN18817

SEQ ID NO: 175368 - RNA, 1410 nt, Artificial Sequence; identical to SEQ ID NO: 169258
  derived and/or modified sequence opt4 from neuraminidase__InfluenzaA__AFN18819

SEQ ID NO: 175369 - RNA, 1410 nt, Artificial Sequence; identical to SEQ ID NO: 172250
  derived and/or modified sequence opt4 from neuraminidase__InfluenzaA__AFN18821

SEQ ID NO: 175370 - RNA, 1410 nt, Artificial Sequence; identical to SEQ ID NO: 169258
  derived and/or modified sequence opt4 from neuraminidase__InfluenzaA__AFN18823

SEQ ID NO: 175371 - RNA, 1410 nt, Artificial Sequence; identical to SEQ ID NO: 169258
  derived and/or modified sequence opt4 from neuraminidase__InfluenzaA__AFN18825

SEQ ID NO: 175372 - RNA, 1410 nt, Artificial Sequence; identical to SEQ ID NO: 169258
  derived and/or modified sequence opt4 from neuraminidase__InfluenzaA__AFN18827

SEQ ID NO: 175373 - RNA, 1410 nt, Artificial Sequence; identical to SEQ ID NO: 169258
  derived and/or modified sequence opt4 from neuraminidase__InfluenzaA__AFN18829

SEQ ID NO: 175374 - RNA, 1410 nt, Artificial Sequence; identical to SEQ ID NO: 169258
  derived and/or modified sequence opt4 from neuraminidase__InfluenzaA__AFN18831

SEQ ID NO: 175375 - RNA, 1410 nt, Artificial Sequence; identical to SEQ ID NO: 170395
  derived and/or modified sequence opt4 from neuraminidase__InfluenzaA__AFN18833

SEQ ID NO: 175376 - RNA, 1410 nt, Artificial Sequence; identical to SEQ ID NO: 170433
  derived and/or modified sequence opt4 from neuraminidase__InfluenzaA__AFN18835

SEQ ID NO: 175377 - RNA, 1410 nt, Artificial Sequence; identical to SEQ ID NO: 169258
  derived and/or modified sequence opt4 from neuraminidase__InfluenzaA__AFN18841

SEQ ID NO: 175378 - RNA, 1410 nt, Artificial Sequence
  derived and/or modified sequence opt4 from neuraminidase__InfluenzaA__AFN18851
augaaccccaaccagaagaucaucaccaucggcagcgugugcaugaccaucggcauggccaaccugauccugcagaucggcaacaugaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175379 - RNA, 1410 nt, Artificial Sequence; identical to SEQ ID NO: 169258
  derived and/or modified sequence opt4 from neuraminidase__InfluenzaA__AFN18857

SEQ ID NO: 175380 - RNA, 1410 nt, Artificial Sequence
  derived and/or modified sequence opt4 from neuraminidase__InfluenzaA__AFN18859
augaaccccaaccagaagaucaucaccaucggcagcgugugcaugaccaucggccuggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175381 - RNA, 1410 nt, Artificial Sequence
  derived and/or modified sequence opt4 from neuraminidase__InfluenzaA__AFN18861
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugcagcgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175382 - RNA, 1410 nt, Artificial Sequence; identical to SEQ ID NO: 169258
  derived and/or modified sequence opt4 from neuraminidase__InfluenzaA__AFN18867

SEQ ID NO: 175383 - RNA, 1410 nt, Artificial Sequence; identical to SEQ ID NO: 171072
  derived and/or modified sequence opt4 from neuraminidase__InfluenzaA__AFN18877

SEQ ID NO: 175384 - RNA, 1410 nt, Artificial Sequence; identical to SEQ ID NO: 169258
  derived and/or modified sequence opt4 from neuraminidase__InfluenzaA__AFN18887

SEQ ID NO: 175385 - RNA, 1410 nt, Artificial Sequence; identical to SEQ ID NO: 170276
  derived and/or modified sequence opt4 from neuraminidase__InfluenzaA__AFN18893

SEQ ID NO: 175386 - RNA, 1410 nt, Artificial Sequence
  derived and/or modified sequence opt4 from neuraminidase__InfluenzaA__AFN18895
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucaagggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175387 - RNA, 1410 nt, Artificial Sequence; identical to SEQ ID NO: 171160
  derived and/or modified sequence opt4 from neuraminidase__InfluenzaA__AFN18905

SEQ ID NO: 175388 - RNA, 1410 nt, Artificial Sequence; identical to SEQ ID NO: 171072
  derived and/or modified sequence opt4 from neuraminidase__InfluenzaA__AFN18913

SEQ ID NO: 175389 - RNA, 1410 nt, Artificial Sequence
  derived and/or modified sequence opt4 from neuraminidase__InfluenzaA__AFN18919
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgagaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175390 - RNA, 1410 nt, Artificial Sequence
  derived and/or modified sequence opt4 from neuraminidase__InfluenzaA__AFN18929
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucacccugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggagcgacggcgccgagcugcccuucaccaucgacaaguga

SEQ ID NO: 175391 - RNA, 1410 nt, Artificial Sequence; identical to SEQ ID NO: 169258
  derived and/or modified sequence opt4 from neuraminidase__InfluenzaA__AFN18939

SEQ ID NO: 175392 - RNA, 1410 nt, Artificial Sequence; identical to SEQ ID NO: 169258
  derived and/or modified sequence opt4 from neuraminidase__InfluenzaA__AFN18953

SEQ ID NO: 175393 - RNA, 1410 nt, Artificial Sequence; identical to SEQ ID NO: 169258
  derived and/or modified sequence opt4 from neuraminidase__InfluenzaA__AFN18959

SEQ ID NO: 175394 - RNA, 1410 nt, Artificial Sequence; identical to SEQ ID NO: 169258
  derived and/or modified sequence opt4 from neuraminidase__InfluenzaA__AFN18965

SEQ ID NO: 175395 - RNA, 1410 nt, Artificial Sequence; identical to SEQ ID NO: 173328
  derived and/or modified sequence opt4 from neuraminidase__InfluenzaA__AFN18975

SEQ ID NO: 175396 - RNA, 1410 nt, Artificial Sequence; identical to SEQ ID NO: 169258
  derived and/or modified sequence opt4 from neuraminidase__InfluenzaA__AFN18981

SEQ ID NO: 175397 - RNA, 1410 nt, Artificial Sequence
  derived and/or modified sequence opt4 from neuraminidase__InfluenzaA__AFN18983
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgccagcaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 175398 - RNA, 1410 nt, Artificial Sequence; identical to SEQ ID NO: 169258
  derived and/or modified sequence opt4 from neuraminidase__InfluenzaA__AFN18985

SEQ ID NO: 175399 - RNA, 1410 nt, Artificial Sequence
  derived and/or modified sequence opt4 from neuraminidase__InfluenzaA__AFN18987
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaucgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175400 - RNA, 1410 nt, Artificial Sequence; identical to SEQ ID NO: 169258
  derived and/or modified sequence opt4 from neuraminidase__InfluenzaA__AFN18989

SEQ ID NO: 175401 - RNA, 1410 nt, Artificial Sequence; identical to SEQ ID NO: 169258
  derived and/or modified sequence opt4 from neuraminidase__InfluenzaA__AFN18995

SEQ ID NO: 175402 - RNA, 1410 nt, Artificial Sequence; identical to SEQ ID NO: 175380
  derived and/or modified sequence opt4 from neuraminidase__InfluenzaA__AFN19001

SEQ ID NO: 175403 - RNA, 1410 nt, Artificial Sequence; identical to SEQ ID NO: 169258
  derived and/or modified sequence opt4 from neuraminidase__InfluenzaA__AFN19007

SEQ ID NO: 175404 - RNA, 1410 nt, Artificial Sequence; identical to SEQ ID NO: 169258
  derived and/or modified sequence opt4 from neuraminidase__InfluenzaA__AFN19024

SEQ ID NO: 175405 - RNA, 1410 nt, Artificial Sequence
  derived and/or modified sequence opt4 from neuraminidase__InfluenzaA__AFN19025
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaagauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175406 - RNA, 1410 nt, Artificial Sequence; identical to SEQ ID NO: 169258
  derived and/or modified sequence opt4 from neuraminidase__InfluenzaA__AFN19027

SEQ ID NO: 175407 - RNA, 1410 nt, Artificial Sequence; identical to SEQ ID NO: 169258
  derived and/or modified sequence opt4 from neuraminidase__InfluenzaA__AFN19032

SEQ ID NO: 175408 - RNA, 1410 nt, Artificial Sequence; identical to SEQ ID NO: 169258
  derived and/or modified sequence opt4 from neuraminidase__InfluenzaA__AFN19038

SEQ ID NO: 175409 - RNA, 1410 nt, Artificial Sequence; identical to SEQ ID NO: 174891
  derived and/or modified sequence opt4 from neuraminidase__InfluenzaA__AFN19049

SEQ ID NO: 175410 - RNA, 1410 nt, Artificial Sequence; identical to SEQ ID NO: 169258
  derived and/or modified sequence opt4 from neuraminidase__InfluenzaA__AFN19055

SEQ ID NO: 175411 - RNA, 1410 nt, Artificial Sequence; identical to SEQ ID NO: 169258
  derived and/or modified sequence opt4 from neuraminidase__InfluenzaA__AFN19065

SEQ ID NO: 175412 - RNA, 1410 nt, Artificial Sequence; identical to SEQ ID NO: 169258
  derived and/or modified sequence opt4 from neuraminidase__InfluenzaA__AFN19071

SEQ ID NO: 175413 - RNA, 1410 nt, Artificial Sequence; identical to SEQ ID NO: 169258
  derived and/or modified sequence opt4 from neuraminidase__InfluenzaA__AFN19077

SEQ ID NO: 175414 - RNA, 1410 nt, Artificial Sequence; identical to SEQ ID NO: 169258
  derived and/or modified sequence opt4 from neuraminidase__InfluenzaA__AFN19083

SEQ ID NO: 175415 - RNA, 1410 nt, Artificial Sequence; identical to SEQ ID NO: 169258
  derived and/or modified sequence opt4 from neuraminidase__InfluenzaA__AFN19089

SEQ ID NO: 175416 - RNA, 1410 nt, Artificial Sequence; identical to SEQ ID NO: 169258
  derived and/or modified sequence opt4 from neuraminidase__InfluenzaA__AFN19099

SEQ ID NO: 175417 - RNA, 1410 nt, Artificial Sequence; identical to SEQ ID NO: 169258
  derived and/or modified sequence opt4 from neuraminidase__InfluenzaA__AFN19105

SEQ ID NO: 175418 - RNA, 1410 nt, Artificial Sequence; identical to SEQ ID NO: 169258
  derived and/or modified sequence opt4 from neuraminidase__InfluenzaA__AFN19114

SEQ ID NO: 175419 - RNA, 1410 nt, Artificial Sequence; identical to SEQ ID NO: 169258
  derived and/or modified sequence opt4 from neuraminidase__InfluenzaA__AFN19126

SEQ ID NO: 175420 - RNA, 1410 nt, Artificial Sequence; identical to SEQ ID NO: 169258
  derived and/or modified sequence opt4 from neuraminidase__InfluenzaA__AFN19136

SEQ ID NO: 175421 - RNA, 1410 nt, Artificial Sequence; identical to SEQ ID NO: 169258
  derived and/or modified sequence opt4 from neuraminidase__InfluenzaA__AFN19146

SEQ ID NO: 175422 - RNA, 1410 nt, Artificial Sequence; identical to SEQ ID NO: 169258
  derived and/or modified sequence opt4 from neuraminidase__InfluenzaA__AFN19156

SEQ ID NO: 175423 - RNA, 1410 nt, Artificial Sequence; identical to SEQ ID NO: 169258
  derived and/or modified sequence opt4 from neuraminidase__InfluenzaA__AFN19166

SEQ ID NO: 175424 - RNA, 1410 nt, Artificial Sequence; identical to SEQ ID NO: 169258
  derived and/or modified sequence opt4 from neuraminidase__InfluenzaA__AFN19186

SEQ ID NO: 175425 - RNA, 1410 nt, Artificial Sequence; identical to SEQ ID NO: 174891
  derived and/or modified sequence opt4 from neuraminidase__InfluenzaA__AFN19196

SEQ ID NO: 175426 - RNA, 1410 nt, Artificial Sequence; identical to SEQ ID NO: 169258
  derived and/or modified sequence opt4 from neuraminidase__InfluenzaA__AFN19205

SEQ ID NO: 175427 - RNA, 1410 nt, Artificial Sequence; identical to SEQ ID NO: 169258
  derived and/or modified sequence opt4 from neuraminidase__InfluenzaA__AFN19215

SEQ ID NO: 175428 - RNA, 1410 nt, Artificial Sequence; identical to SEQ ID NO: 169258
  derived and/or modified sequence opt4 from neuraminidase__InfluenzaA__AFN19225

SEQ ID NO: 175429 - RNA, 1410 nt, Artificial Sequence; identical to SEQ ID NO: 169258
  derived and/or modified sequence opt4 from neuraminidase__InfluenzaA__AFN19235

SEQ ID NO: 175430 - RNA, 1410 nt, Artificial Sequence; identical to SEQ ID NO: 169258
  derived and/or modified sequence opt4 from neuraminidase__InfluenzaA__AFN19245

SEQ ID NO: 175431 - RNA, 1410 nt, Artificial Sequence; identical to SEQ ID NO: 169258
  derived and/or modified sequence opt4 from neuraminidase__InfluenzaA__AFN19251

SEQ ID NO: 175432 - RNA, 1410 nt, Artificial Sequence; identical to SEQ ID NO: 169258
  derived and/or modified sequence opt4 from neuraminidase__InfluenzaA__AFN19261

SEQ ID NO: 175433 - RNA, 1410 nt, Artificial Sequence; identical to SEQ ID NO: 174891
  derived and/or modified sequence opt4 from neuraminidase__InfluenzaA__AFN19271

SEQ ID NO: 175434 - RNA, 1410 nt, Artificial Sequence; identical to SEQ ID NO: 170989
  derived and/or modified sequence opt4 from neuraminidase__InfluenzaA__AFN19281

SEQ ID NO: 175435 - RNA, 1410 nt, Artificial Sequence
  derived and/or modified sequence opt4 from neuraminidase__InfluenzaA__AFN19287
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugagcgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175436 - RNA, 1410 nt, Artificial Sequence; identical to SEQ ID NO: 169258
  derived and/or modified sequence opt4 from neuraminidase__InfluenzaA__AFN19297

SEQ ID NO: 175437 - RNA, 1410 nt, Artificial Sequence; identical to SEQ ID NO: 169258
  derived and/or modified sequence opt4 from neuraminidase__InfluenzaA__AFN19307

SEQ ID NO: 175438 - RNA, 1410 nt, Artificial Sequence; identical to SEQ ID NO: 169258
  derived and/or modified sequence opt4 from neuraminidase__InfluenzaA__AFN19317

SEQ ID NO: 175439 - RNA, 1410 nt, Artificial Sequence; identical to SEQ ID NO: 174891
  derived and/or modified sequence opt4 from neuraminidase__InfluenzaA__AFN19327

SEQ ID NO: 175440 - RNA, 1410 nt, Artificial Sequence; identical to SEQ ID NO: 169258
  derived and/or modified sequence opt4 from neuraminidase__InfluenzaA__AFN19346

SEQ ID NO: 175441 - RNA, 1410 nt, Artificial Sequence
  derived and/or modified sequence opt4 from neuraminidase__InfluenzaA__AFN19352
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175442 - RNA, 1410 nt, Artificial Sequence
  derived and/or modified sequence opt4 from neuraminidase__InfluenzaA__AFN19354
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175443 - RNA, 1410 nt, Artificial Sequence; identical to SEQ ID NO: 175442
  derived and/or modified sequence opt4 from neuraminidase__InfluenzaA__AFN19356

SEQ ID NO: 175444 - RNA, 1410 nt, Artificial Sequence; identical to SEQ ID NO: 175442
  derived and/or modified sequence opt4 from neuraminidase__InfluenzaA__AFN19358

SEQ ID NO: 175445 - RNA, 1410 nt, Artificial Sequence; identical to SEQ ID NO: 175442
  derived and/or modified sequence opt4 from neuraminidase__InfluenzaA__AFN19360

SEQ ID NO: 175446 - RNA, 1410 nt, Artificial Sequence
  derived and/or modified sequence opt4 from neuraminidase__InfluenzaA__AFN19362
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagaugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175447 - RNA, 1410 nt, Artificial Sequence; identical to SEQ ID NO: 175442
  derived and/or modified sequence opt4 from neuraminidase__InfluenzaA__AFN19364

SEQ ID NO: 175448 - RNA, 1410 nt, Artificial Sequence; identical to SEQ ID NO: 172038
  derived and/or modified sequence opt4 from neuraminidase__InfluenzaA__AFN19366

SEQ ID NO: 175449 - RNA, 1410 nt, Artificial Sequence; identical to SEQ ID NO: 175442
  derived and/or modified sequence opt4 from neuraminidase__InfluenzaA__AFN19370

SEQ ID NO: 175450 - RNA, 1410 nt, Artificial Sequence
  derived and/or modified sequence opt4 from neuraminidase__InfluenzaA__AFN19374
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175451 - RNA, 1410 nt, Artificial Sequence; identical to SEQ ID NO: 175442
  derived and/or modified sequence opt4 from neuraminidase__InfluenzaA__AFN19376

SEQ ID NO: 175452 - RNA, 1410 nt, Artificial Sequence; identical to SEQ ID NO: 175442
  derived and/or modified sequence opt4 from neuraminidase__InfluenzaA__AFN19378

SEQ ID NO: 175453 - RNA, 1410 nt, Artificial Sequence
  derived and/or modified sequence opt4 from neuraminidase__InfluenzaA__AFN19380
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccagcgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175454 - RNA, 1410 nt, Artificial Sequence; identical to SEQ ID NO: 175450
  derived and/or modified sequence opt4 from neuraminidase__InfluenzaA__AFN19382

SEQ ID NO: 175455 - RNA, 1410 nt, Artificial Sequence; identical to SEQ ID NO: 175442
  derived and/or modified sequence opt4 from neuraminidase__InfluenzaA__AFN19384

SEQ ID NO: 175456 - RNA, 1410 nt, Artificial Sequence
  derived and/or modified sequence opt4 from neuraminidase__InfluenzaA__AFN19386
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacagaucaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175457 - RNA, 1410 nt, Artificial Sequence; identical to SEQ ID NO: 175442
  derived and/or modified sequence opt4 from neuraminidase__InfluenzaA__AFN19388

SEQ ID NO: 175458 - RNA, 1410 nt, Artificial Sequence; identical to SEQ ID NO: 175442
  derived and/or modified sequence opt4 from neuraminidase__InfluenzaA__AFN19390

SEQ ID NO: 175459 - RNA, 1410 nt, Artificial Sequence
  derived and/or modified sequence opt4 from neuraminidase__InfluenzaA__AFN19392
augaaccccaaccagaagaucaucaccaucggcagcgugagccugaccaucagcaccaucugcuucuucaugcagaucgccgugcugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175460 - RNA, 1410 nt, Artificial Sequence; identical to SEQ ID NO: 174307
  derived and/or modified sequence opt4 from neuraminidase__InfluenzaA__AFN19394

SEQ ID NO: 175461 - RNA, 1410 nt, Artificial Sequence
  derived and/or modified sequence opt4 from neuraminidase__InfluenzaA__AFN19396
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175462 - RNA, 1410 nt, Artificial Sequence
  derived and/or modified sequence opt4 from neuraminidase__InfluenzaA__AFN19398
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175463 - RNA, 1410 nt, Artificial Sequence
  derived and/or modified sequence opt4 from neuraminidase__InfluenzaA__AFN19400
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccagcgaguacagaaacuggagcaagccccagugcgacaucaccggcuucgcccccuucagcaaggacaacagcaucagacugagcgacggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175464 - RNA, 1410 nt, Artificial Sequence; identical to SEQ ID NO: 175442
  derived and/or modified sequence opt4 from neuraminidase__InfluenzaA__AFN19402

SEQ ID NO: 175465 - RNA, 1410 nt, Artificial Sequence; identical to SEQ ID NO: 175442
  derived and/or modified sequence opt4 from neuraminidase__InfluenzaA__AFN19404

SEQ ID NO: 175466 - RNA, 1410 nt, Artificial Sequence; identical to SEQ ID NO: 175442
  derived and/or modified sequence opt4 from neuraminidase__InfluenzaA__AFN19406

SEQ ID NO: 175467 - RNA, 1410 nt, Artificial Sequence; identical to SEQ ID NO: 175442
  derived and/or modified sequence opt4 from neuraminidase__InfluenzaA__AFN19410

SEQ ID NO: 175468 - RNA, 1410 nt, Artificial Sequence; identical to SEQ ID NO: 175442
  derived and/or modified sequence opt4 from neuraminidase__InfluenzaA__AFN19412

SEQ ID NO: 175469 - RNA, 1410 nt, Artificial Sequence; identical to SEQ ID NO: 175442
  derived and/or modified sequence opt4 from neuraminidase__InfluenzaA__AFN19414

SEQ ID NO: 175470 - RNA, 1410 nt, Artificial Sequence; identical to SEQ ID NO: 175442
  derived and/or modified sequence opt4 from neuraminidase__InfluenzaA__AFN19416

SEQ ID NO: 175471 - RNA, 1410 nt, Artificial Sequence
  derived and/or modified sequence opt4 from neuraminidase__InfluenzaA__AFN19418
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcagagccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175472 - RNA, 1410 nt, Artificial Sequence
  derived and/or modified sequence opt4 from neuraminidase__InfluenzaA__AFN19420
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175473 - RNA, 1410 nt, Artificial Sequence
  derived and/or modified sequence opt4 from neuraminidase__InfluenzaA__AFN19422
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcaacgacaagaacgccaccgccagcuucaucuacaacggcagacugguggacagcguggugagcuggagcaaggaggugcugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175474 - RNA, 1410 nt, Artificial Sequence
  derived and/or modified sequence opt4 from neuraminidase__InfluenzaA__AFN19426
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacgagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175475 - RNA, 1410 nt, Artificial Sequence; identical to SEQ ID NO: 175442
  derived and/or modified sequence opt4 from neuraminidase__InfluenzaA__AFN19428

SEQ ID NO: 175476 - RNA, 1410 nt, Artificial Sequence
  derived and/or modified sequence opt4 from neuraminidase__InfluenzaA__AFN19430
augaaccccaaccagaagaucaucaccaucggcagcgugagccugaccaucagcaccaucugcuucuucaugcagaucgccauccugaucaucaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175477 - RNA, 1410 nt, Artificial Sequence
  derived and/or modified sequence opt4 from neuraminidase__InfluenzaA__AFN19432
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaaccccccacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175478 - RNA, 1410 nt, Artificial Sequence
  derived and/or modified sequence opt4 from neuraminidase__InfluenzaA__AFN19434
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175479 - RNA, 1410 nt, Artificial Sequence; identical to SEQ ID NO: 174666
  derived and/or modified sequence opt4 from neuraminidase__InfluenzaA__AFN19436

SEQ ID NO: 175480 - RNA, 1410 nt, Artificial Sequence
  derived and/or modified sequence opt4 from neuraminidase__InfluenzaA__AFN19438
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugagcaucuga

SEQ ID NO: 175481 - RNA, 1410 nt, Artificial Sequence
  derived and/or modified sequence opt4 from neuraminidase__InfluenzaA__AFN19442
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaucaucgagaaggagaucugccccaagcccaccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcacaucuga

SEQ ID NO: 175482 - RNA, 1410 nt, Artificial Sequence; identical to SEQ ID NO: 174666
  derived and/or modified sequence opt4 from neuraminidase__InfluenzaA__AFN19446

SEQ ID NO: 175483 - RNA, 1410 nt, Artificial Sequence; identical to SEQ ID NO: 174666
  derived and/or modified sequence opt4 from neuraminidase__InfluenzaA__AFN19448

SEQ ID NO: 175484 - RNA, 1410 nt, Artificial Sequence; identical to SEQ ID NO: 175442
  derived and/or modified sequence opt4 from neuraminidase__InfluenzaA__AFN19458

SEQ ID NO: 175485 - RNA, 1410 nt, Artificial Sequence
  derived and/or modified sequence opt4 from neuraminidase__InfluenzaA__AFN19460
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaacgagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 175486 - RNA, 1410 nt, Artificial Sequence; identical to SEQ ID NO: 174666
  derived and/or modified sequence opt4 from neuraminidase__InfluenzaA__AFN19462

SEQ ID NO: 175487 - RNA, 1410 nt, Artificial Sequence
  derived and/or modified sequence opt4 from neuraminidase__InfluenzaA__AFN19466
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucgccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175488 - RNA, 1410 nt, Artificial Sequence; identical to SEQ ID NO: 174666
  derived and/or modified sequence opt4 from neuraminidase__InfluenzaA__AFN19468

SEQ ID NO: 175489 - RNA, 1410 nt, Artificial Sequence
  derived and/or modified sequence opt4 from neuraminidase__InfluenzaA__AFN19470
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugaacaagagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175490 - RNA, 1410 nt, Artificial Sequence; identical to SEQ ID NO: 175442
  derived and/or modified sequence opt4 from neuraminidase__InfluenzaA__AFN19472

SEQ ID NO: 175491 - RNA, 1410 nt, Artificial Sequence
  derived and/or modified sequence opt4 from neuraminidase__InfluenzaA__AFN19476
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgccccccugagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175492 - RNA, 1410 nt, Artificial Sequence; identical to SEQ ID NO: 175442
  derived and/or modified sequence opt4 from neuraminidase__InfluenzaA__AFN19478

SEQ ID NO: 175493 - RNA, 1410 nt, Artificial Sequence
  derived and/or modified sequence opt4 from neuraminidase__InfluenzaA__AFN19480
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugggcgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175494 - RNA, 1410 nt, Artificial Sequence
  derived and/or modified sequence opt4 from neuraminidase__InfluenzaA__AFN19482
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccaaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175495 - RNA, 1410 nt, Artificial Sequence; identical to SEQ ID NO: 174666
  derived and/or modified sequence opt4 from neuraminidase__InfluenzaA__AFN19484

SEQ ID NO: 175496 - RNA, 1410 nt, Artificial Sequence; identical to SEQ ID NO: 175442
  derived and/or modified sequence opt4 from neuraminidase__InfluenzaA__AFN19488

SEQ ID NO: 175497 - RNA, 1410 nt, Artificial Sequence
  derived and/or modified sequence opt4 from neuraminidase__InfluenzaA__AFN19492
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175498 - RNA, 1410 nt, Artificial Sequence
  derived and/or modified sequence opt4 from neuraminidase__InfluenzaA__AFN19494
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175499 - RNA, 1410 nt, Artificial Sequence; identical to SEQ ID NO: 174307
  derived and/or modified sequence opt4 from neuraminidase__InfluenzaA__AFN19496

SEQ ID NO: 175500 - RNA, 1410 nt, Artificial Sequence
  derived and/or modified sequence opt4 from neuraminidase__InfluenzaA__AFN19498
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaccgaggagaccgaggugcuguggaccagcaacagcaucgugguguucugcggcaccagcggcaccuacggcaccggcagcuggcccgacggcgccgaccugaaccugaugcccaucuga

SEQ ID NO: 175501 - RNA, 1410 nt, Artificial Sequence; identical to SEQ ID NO: 175450
  derived and/or modified sequence opt4 from neuraminidase__InfluenzaA__AFN19500

SEQ ID NO: 175502 - RNA, 1410 nt, Artificial Sequence; identical to SEQ ID NO: 175442
  derived and/or modified sequence opt4 from neuraminidase__InfluenzaA__AFN19502

SEQ ID NO: 175503 - RNA, 1410 nt, Artificial Sequence; identical to SEQ ID NO: 172038
  derived and/or modified sequence opt4 from neuraminidase__InfluenzaA__AFN19504

SEQ ID NO: 175504 - RNA, 1410 nt, Artificial Sequence; identical to SEQ ID NO: 172038
  derived and/or modified sequence opt4 from neuraminidase__InfluenzaA__AFN19506

SEQ ID NO: 175505 - RNA, 1410 nt, Artificial Sequence; identical to SEQ ID NO: 175450
  derived and/or modified sequence opt4 from neuraminidase__InfluenzaA__AFN19508

SEQ ID NO: 175506 - RNA, 1410 nt, Artificial Sequence; identical to SEQ ID NO: 175442
  derived and/or modified sequence opt4 from neuraminidase__InfluenzaA__AFN19510

SEQ ID NO: 175507 - RNA, 1410 nt, Artificial Sequence; identical to SEQ ID NO: 175442
  derived and/or modified sequence opt4 from neuraminidase__InfluenzaA__AFN19512

SEQ ID NO: 175508 - RNA, 1410 nt, Artificial Sequence; identical to SEQ ID NO: 175442
  derived and/or modified sequence opt4 from neuraminidase__InfluenzaA__AFN19516

SEQ ID NO: 175509 - RNA, 1410 nt, Artificial Sequence; identical to SEQ ID NO: 175450
  derived and/or modified sequence opt4 from neuraminidase__InfluenzaA__AFN19518

SEQ ID NO: 175510 - RNA, 1410 nt, Artificial Sequence; identical to SEQ ID NO: 175450
  derived and/or modified sequence opt4 from neuraminidase__InfluenzaA__AFN19520

SEQ ID NO: 175511 - RNA, 1410 nt, Artificial Sequence; identical to SEQ ID NO: 175442
  derived and/or modified sequence opt4 from neuraminidase__InfluenzaA__AFN19522

SEQ ID NO: 175512 - RNA, 1410 nt, Artificial Sequence
  derived and/or modified sequence opt4 from neuraminidase__InfluenzaA__AFN19524
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugagccugaugcccaucuga

SEQ ID NO: 175513 - RNA, 1410 nt, Artificial Sequence
  derived and/or modified sequence opt4 from neuraminidase__InfluenzaA__AFN19526
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaccgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175514 - RNA, 1410 nt, Artificial Sequence
  derived and/or modified sequence opt4 from neuraminidase__InfluenzaA__AFN19528
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaagagcgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175515 - RNA, 1410 nt, Artificial Sequence; identical to SEQ ID NO: 175478
  derived and/or modified sequence opt4 from neuraminidase__InfluenzaA__AFN19530

SEQ ID NO: 175516 - RNA, 1410 nt, Artificial Sequence; identical to SEQ ID NO: 175442
  derived and/or modified sequence opt4 from neuraminidase__InfluenzaA__AFN19532

SEQ ID NO: 175517 - RNA, 1410 nt, Artificial Sequence; identical to SEQ ID NO: 175478
  derived and/or modified sequence opt4 from neuraminidase__InfluenzaA__AFN19534

SEQ ID NO: 175518 - RNA, 1410 nt, Artificial Sequence; identical to SEQ ID NO: 175442
  derived and/or modified sequence opt4 from neuraminidase__InfluenzaA__AFN19536

SEQ ID NO: 175519 - RNA, 1410 nt, Artificial Sequence; identical to SEQ ID NO: 175442
  derived and/or modified sequence opt4 from neuraminidase__InfluenzaA__AFN19538

SEQ ID NO: 175520 - RNA, 1410 nt, Artificial Sequence; identical to SEQ ID NO: 175442
  derived and/or modified sequence opt4 from neuraminidase__InfluenzaA__AFN19544

SEQ ID NO: 175521 - RNA, 1410 nt, Artificial Sequence
  derived and/or modified sequence opt4 from neuraminidase__InfluenzaA__AFN19546
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugagcgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175522 - RNA, 1410 nt, Artificial Sequence
  derived and/or modified sequence opt4 from neuraminidase__InfluenzaA__AFN19548
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175523 - RNA, 1410 nt, Artificial Sequence
  derived and/or modified sequence opt4 from neuraminidase__InfluenzaA__AFN19550
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175524 - RNA, 1410 nt, Artificial Sequence; identical to SEQ ID NO: 175442
  derived and/or modified sequence opt4 from neuraminidase__InfluenzaA__AFN19552

SEQ ID NO: 175525 - RNA, 1410 nt, Artificial Sequence; identical to SEQ ID NO: 174666
  derived and/or modified sequence opt4 from neuraminidase__InfluenzaA__AFN19554

SEQ ID NO: 175526 - RNA, 1410 nt, Artificial Sequence; identical to SEQ ID NO: 174666
  derived and/or modified sequence opt4 from neuraminidase__InfluenzaA__AFN19556

SEQ ID NO: 175527 - RNA, 1410 nt, Artificial Sequence
  derived and/or modified sequence opt4 from neuraminidase__InfluenzaA__AFN19558
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaugaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175528 - RNA, 1410 nt, Artificial Sequence
  derived and/or modified sequence opt4 from neuraminidase__InfluenzaA__AFN19560
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgagggcggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175529 - RNA, 1410 nt, Artificial Sequence; identical to SEQ ID NO: 175489
  derived and/or modified sequence opt4 from neuraminidase__InfluenzaA__AFN19562

SEQ ID NO: 175530 - RNA, 1410 nt, Artificial Sequence
  derived and/or modified sequence opt4 from neuraminidase__InfluenzaA__AFN19564
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175531 - RNA, 1410 nt, Artificial Sequence
  derived and/or modified sequence opt4 from neuraminidase__InfluenzaA__AFN19566
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaacgagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 175532 - RNA, 1410 nt, Artificial Sequence
  derived and/or modified sequence opt4 from neuraminidase__InfluenzaA__AFN19568
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcaggugaacagacaggugaucguggacagaggcgacagaagcggcuacagcggcaucuucagcguggagggcaagagcugcaucaacagaugcuucuacguggagcugaucagaggcagaaaggaggagaucgaggugcuguggaccagcaacagcaucgugguguucugcggcaccagcggcaccuacggcaccggcagcuggcccgacggcgccgaccugaaccugaugcccaucuga

SEQ ID NO: 175533 - RNA, 1410 nt, Artificial Sequence
  derived and/or modified sequence opt4 from neuraminidase__InfluenzaA__AFN19570
augaaccccaaccagaagaucaucaccaucggcagcgugagccugaccaucagcaccaucugcuucuucaugcagaucgccauccugaucaccaccgugacccugcacuucaagcaguacgaguucaacuacccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaacgagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 175534 - RNA, 1410 nt, Artificial Sequence
  derived and/or modified sequence opt4 from neuraminidase__InfluenzaA__AFN19572
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagaaucagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175535 - RNA, 1410 nt, Artificial Sequence
  derived and/or modified sequence opt4 from neuraminidase__InfluenzaA__AFN19574
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugcuucgaccccaacgacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagcaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175536 - RNA, 1410 nt, Artificial Sequence
  derived and/or modified sequence opt4 from neuraminidase__InfluenzaA__AFN19576
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175537 - RNA, 1410 nt, Artificial Sequence; identical to SEQ ID NO: 175442
  derived and/or modified sequence opt4 from neuraminidase__InfluenzaA__AFN19578

SEQ ID NO: 175538 - RNA, 1410 nt, Artificial Sequence; identical to SEQ ID NO: 175442
  derived and/or modified sequence opt4 from neuraminidase__InfluenzaA__AFN19582

SEQ ID NO: 175539 - RNA, 1410 nt, Artificial Sequence; identical to SEQ ID NO: 175442
  derived and/or modified sequence opt4 from neuraminidase__InfluenzaA__AFN19584

SEQ ID NO: 175540 - RNA, 1410 nt, Artificial Sequence; identical to SEQ ID NO: 175442
  derived and/or modified sequence opt4 from neuraminidase__InfluenzaA__AFN19588

SEQ ID NO: 175541 - RNA, 1410 nt, Artificial Sequence; identical to SEQ ID NO: 175442
  derived and/or modified sequence opt4 from neuraminidase__InfluenzaA__AFN19590

SEQ ID NO: 175542 - RNA, 1410 nt, Artificial Sequence; identical to SEQ ID NO: 175478
  derived and/or modified sequence opt4 from neuraminidase__InfluenzaA__AFN19592

SEQ ID NO: 175543 - RNA, 1410 nt, Artificial Sequence; identical to SEQ ID NO: 175442
  derived and/or modified sequence opt4 from neuraminidase__InfluenzaA__AFN19594

SEQ ID NO: 175544 - RNA, 1410 nt, Artificial Sequence; identical to SEQ ID NO: 175450
  derived and/or modified sequence opt4 from neuraminidase__InfluenzaA__AFN19596

SEQ ID NO: 175545 - RNA, 1410 nt, Artificial Sequence; identical to SEQ ID NO: 175450
  derived and/or modified sequence opt4 from neuraminidase__InfluenzaA__AFN19600

SEQ ID NO: 175546 - RNA, 1410 nt, Artificial Sequence
  derived and/or modified sequence opt4 from neuraminidase__InfluenzaA__AFN19602
augaaccccaaccagaagaucaucaccaucggcagcgugagccugacccugagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175547 - RNA, 1410 nt, Artificial Sequence; identical to SEQ ID NO: 175442
  derived and/or modified sequence opt4 from neuraminidase__InfluenzaA__AFN19604

SEQ ID NO: 175548 - RNA, 1410 nt, Artificial Sequence; identical to SEQ ID NO: 175442
  derived and/or modified sequence opt4 from neuraminidase__InfluenzaA__AFN19606

SEQ ID NO: 175549 - RNA, 1410 nt, Artificial Sequence; identical to SEQ ID NO: 175442
  derived and/or modified sequence opt4 from neuraminidase__InfluenzaA__AFN19608

SEQ ID NO: 175550 - RNA, 1410 nt, Artificial Sequence; identical to SEQ ID NO: 175442
  derived and/or modified sequence opt4 from neuraminidase__InfluenzaA__AFN19610

SEQ ID NO: 175551 - RNA, 1410 nt, Artificial Sequence; identical to SEQ ID NO: 175450
  derived and/or modified sequence opt4 from neuraminidase__InfluenzaA__AFN19612

SEQ ID NO: 175552 - RNA, 1410 nt, Artificial Sequence; identical to SEQ ID NO: 174666
  derived and/or modified sequence opt4 from neuraminidase__InfluenzaA__AFN19614

SEQ ID NO: 175553 - RNA, 1410 nt, Artificial Sequence
  derived and/or modified sequence opt4 from neuraminidase__InfluenzaA__AFN19618
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaacgagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175554 - RNA, 1410 nt, Artificial Sequence; identical to SEQ ID NO: 175442
  derived and/or modified sequence opt4 from neuraminidase__InfluenzaA__AFN19620

SEQ ID NO: 175555 - RNA, 1410 nt, Artificial Sequence; identical to SEQ ID NO: 175478
  derived and/or modified sequence opt4 from neuraminidase__InfluenzaA__AFN19624

SEQ ID NO: 175556 - RNA, 1410 nt, Artificial Sequence; identical to SEQ ID NO: 175442
  derived and/or modified sequence opt4 from neuraminidase__InfluenzaA__AFN19630

SEQ ID NO: 175557 - RNA, 1410 nt, Artificial Sequence
  derived and/or modified sequence opt4 from neuraminidase__InfluenzaA__AFN19632
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccaccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175558 - RNA, 1410 nt, Artificial Sequence
  derived and/or modified sequence opt4 from neuraminidase__InfluenzaA__AFN19634
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaaccagcuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175559 - RNA, 1410 nt, Artificial Sequence
  derived and/or modified sequence opt4 from neuraminidase__InfluenzaA__AFN19636
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaucaucgagaaggagaucugccccaagcccaccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175560 - RNA, 1410 nt, Artificial Sequence; identical to SEQ ID NO: 175559
  derived and/or modified sequence opt4 from neuraminidase__InfluenzaA__AFN19638

SEQ ID NO: 175561 - RNA, 1410 nt, Artificial Sequence; identical to SEQ ID NO: 175442
  derived and/or modified sequence opt4 from neuraminidase__InfluenzaA__AFN19640

SEQ ID NO: 175562 - RNA, 1410 nt, Artificial Sequence
  derived and/or modified sequence opt4 from neuraminidase__InfluenzaA__AFN19642
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagcgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175563 - RNA, 1410 nt, Artificial Sequence; identical to SEQ ID NO: 175559
  derived and/or modified sequence opt4 from neuraminidase__InfluenzaA__AFN19644

SEQ ID NO: 175564 - RNA, 1410 nt, Artificial Sequence
  derived and/or modified sequence opt4 from neuraminidase__InfluenzaA__AFN19646
augaaccccaaccagaagaucaucaccaucggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugaacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175565 - RNA, 1410 nt, Artificial Sequence; identical to SEQ ID NO: 175442
  derived and/or modified sequence opt4 from neuraminidase__InfluenzaA__AFN19648

SEQ ID NO: 175566 - RNA, 1410 nt, Artificial Sequence; identical to SEQ ID NO: 175478
  derived and/or modified sequence opt4 from neuraminidase__InfluenzaA__AFN19650

SEQ ID NO: 175567 - RNA, 1410 nt, Artificial Sequence
  derived and/or modified sequence opt4 from neuraminidase__InfluenzaA__AFN19652
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgaggugguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175568 - RNA, 1410 nt, Artificial Sequence
  derived and/or modified sequence opt4 from neuraminidase__InfluenzaA__AFN19654
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaccugccccaagcccaccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175569 - RNA, 1410 nt, Artificial Sequence; identical to SEQ ID NO: 175442
  derived and/or modified sequence opt4 from neuraminidase__InfluenzaA__AFN19656

SEQ ID NO: 175570 - RNA, 1410 nt, Artificial Sequence; identical to SEQ ID NO: 174666
  derived and/or modified sequence opt4 from neuraminidase__InfluenzaA__AFN19658

SEQ ID NO: 175571 - RNA, 1410 nt, Artificial Sequence; identical to SEQ ID NO: 175559
  derived and/or modified sequence opt4 from neuraminidase__InfluenzaA__AFN19660

SEQ ID NO: 175572 - RNA, 1410 nt, Artificial Sequence; identical to SEQ ID NO: 174666
  derived and/or modified sequence opt4 from neuraminidase__InfluenzaA__AFN19662

SEQ ID NO: 175573 - RNA, 1410 nt, Artificial Sequence
  derived and/or modified sequence opt4 from neuraminidase__InfluenzaA__AFN19664
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaacaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175574 - RNA, 1410 nt, Artificial Sequence
  derived and/or modified sequence opt4 from neuraminidase__InfluenzaA__AFN19666
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugaacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175575 - RNA, 1410 nt, Artificial Sequence
  derived and/or modified sequence opt4 from neuraminidase__InfluenzaA__AFN19668
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgagcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175576 - RNA, 1410 nt, Artificial Sequence; identical to SEQ ID NO: 175478
  derived and/or modified sequence opt4 from neuraminidase__InfluenzaA__AFN19670

SEQ ID NO: 175577 - RNA, 1410 nt, Artificial Sequence; identical to SEQ ID NO: 174666
  derived and/or modified sequence opt4 from neuraminidase__InfluenzaA__AFN19673

SEQ ID NO: 175578 - RNA, 1410 nt, Artificial Sequence; identical to SEQ ID NO: 175442
  derived and/or modified sequence opt4 from neuraminidase__InfluenzaA__AFN19675

SEQ ID NO: 175579 - RNA, 1410 nt, Artificial Sequence
  derived and/or modified sequence opt4 from neuraminidase__InfluenzaA__AFN19677
augaaccccaaccagaagaucaucaccaucggcagcgugagccugaccaucagcaucaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175580 - RNA, 1410 nt, Artificial Sequence; identical to SEQ ID NO: 175478
  derived and/or modified sequence opt4 from neuraminidase__InfluenzaA__AFN19683

SEQ ID NO: 175581 - RNA, 1410 nt, Artificial Sequence; identical to SEQ ID NO: 175442
  derived and/or modified sequence opt4 from neuraminidase__InfluenzaA__AFN19685

SEQ ID NO: 175582 - RNA, 1410 nt, Artificial Sequence; identical to SEQ ID NO: 175442
  derived and/or modified sequence opt4 from neuraminidase__InfluenzaA__AFN19687

SEQ ID NO: 175583 - RNA, 1410 nt, Artificial Sequence; identical to SEQ ID NO: 175442
  derived and/or modified sequence opt4 from neuraminidase__InfluenzaA__AFN19689

SEQ ID NO: 175584 - RNA, 1410 nt, Artificial Sequence; identical to SEQ ID NO: 174666
  derived and/or modified sequence opt4 from neuraminidase__InfluenzaA__AFN19691

SEQ ID NO: 175585 - RNA, 1410 nt, Artificial Sequence
  derived and/or modified sequence opt4 from neuraminidase__InfluenzaA__AFN19693
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagcaacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175586 - RNA, 1410 nt, Artificial Sequence
  derived and/or modified sequence opt4 from neuraminidase__InfluenzaA__AFN19697
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagacccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175587 - RNA, 1410 nt, Artificial Sequence; identical to SEQ ID NO: 175442
  derived and/or modified sequence opt4 from neuraminidase__InfluenzaA__AFN19699

SEQ ID NO: 175588 - RNA, 1410 nt, Artificial Sequence; identical to SEQ ID NO: 175478
  derived and/or modified sequence opt4 from neuraminidase__InfluenzaA__AFN19701

SEQ ID NO: 175589 - RNA, 1410 nt, Artificial Sequence
  derived and/or modified sequence opt4 from neuraminidase__InfluenzaA__AFN19703
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccuggacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175590 - RNA, 1410 nt, Artificial Sequence; identical to SEQ ID NO: 172777
  derived and/or modified sequence opt4 from neuraminidase__InfluenzaA__AFN19711

SEQ ID NO: 175591 - RNA, 1410 nt, Artificial Sequence
  derived and/or modified sequence opt4 from neuraminidase__InfluenzaA__AFN19721
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccauggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175592 - RNA, 1410 nt, Artificial Sequence; identical to SEQ ID NO: 173598
  derived and/or modified sequence opt4 from neuraminidase__InfluenzaA__AFN19731

SEQ ID NO: 175593 - RNA, 1410 nt, Artificial Sequence; identical to SEQ ID NO: 172777
  derived and/or modified sequence opt4 from neuraminidase__InfluenzaA__AFN19737

SEQ ID NO: 175594 - RNA, 1410 nt, Artificial Sequence
  derived and/or modified sequence opt4 from neuraminidase__InfluenzaA__AFN19747
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucacccacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcgccaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175595 - RNA, 1410 nt, Artificial Sequence; identical to SEQ ID NO: 172777
  derived and/or modified sequence opt4 from neuraminidase__InfluenzaA__AFN19749

SEQ ID NO: 175596 - RNA, 1410 nt, Artificial Sequence; identical to SEQ ID NO: 172777
  derived and/or modified sequence opt4 from neuraminidase__InfluenzaA__AFN19759

SEQ ID NO: 175597 - RNA, 1410 nt, Artificial Sequence
  derived and/or modified sequence opt4 from neuraminidase__InfluenzaA__AFN19769
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacagagccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175598 - RNA, 1410 nt, Artificial Sequence; identical to SEQ ID NO: 172777
  derived and/or modified sequence opt4 from neuraminidase__InfluenzaA__AFN19783

SEQ ID NO: 175599 - RNA, 1410 nt, Artificial Sequence; identical to SEQ ID NO: 173478
  derived and/or modified sequence opt4 from neuraminidase__InfluenzaA__AFN19793

SEQ ID NO: 175600 - RNA, 1410 nt, Artificial Sequence; identical to SEQ ID NO: 172777
  derived and/or modified sequence opt4 from neuraminidase__InfluenzaA__AFN19807

SEQ ID NO: 175601 - RNA, 1410 nt, Artificial Sequence
  derived and/or modified sequence opt4 from neuraminidase__InfluenzaA__AFN19809
augaaccccaaccagaagaucaucaccaucggcagcgugugcaugaucaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcgugaucagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcaccaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175602 - RNA, 1410 nt, Artificial Sequence; identical to SEQ ID NO: 173600
  derived and/or modified sequence opt4 from neuraminidase__InfluenzaA__AFN19815

SEQ ID NO: 175603 - RNA, 1410 nt, Artificial Sequence
  derived and/or modified sequence opt4 from neuraminidase__InfluenzaA__AFN19833
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175604 - RNA, 1410 nt, Artificial Sequence; identical to SEQ ID NO: 173236
  derived and/or modified sequence opt4 from neuraminidase__InfluenzaA__AFN19851

SEQ ID NO: 175605 - RNA, 1410 nt, Artificial Sequence; identical to SEQ ID NO: 172777
  derived and/or modified sequence opt4 from neuraminidase__InfluenzaA__AFN19857

SEQ ID NO: 175606 - RNA, 1410 nt, Artificial Sequence
  derived and/or modified sequence opt4 from neuraminidase__InfluenzaA__AFN19867
augaaccccaaccagaagaucaucaccaucggcagcgugugcaugaccaucggcauggccaaccugauccugcagaucggcaacaucaucagcaucuggaucagccacagcauccagaucggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaucaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175607 - RNA, 1410 nt, Artificial Sequence; identical to SEQ ID NO: 173229
  derived and/or modified sequence opt4 from neuraminidase__InfluenzaA__AFN19877

SEQ ID NO: 175608 - RNA, 1410 nt, Artificial Sequence; identical to SEQ ID NO: 172777
  derived and/or modified sequence opt4 from neuraminidase__InfluenzaA__AFN19887

SEQ ID NO: 175609 - RNA, 1410 nt, Artificial Sequence
  derived and/or modified sequence opt4 from neuraminidase__InfluenzaA__AFN19897
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccugcaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175610 - RNA, 1410 nt, Artificial Sequence; identical to SEQ ID NO: 172777
  derived and/or modified sequence opt4 from neuraminidase__InfluenzaA__AFN19907

SEQ ID NO: 175611 - RNA, 1410 nt, Artificial Sequence; identical to SEQ ID NO: 173236
  derived and/or modified sequence opt4 from neuraminidase__InfluenzaA__AFN19917

SEQ ID NO: 175612 - RNA, 1410 nt, Artificial Sequence
  derived and/or modified sequence opt4 from neuraminidase__InfluenzaA__AFN19923
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagaacgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175613 - RNA, 1410 nt, Artificial Sequence; identical to SEQ ID NO: 172777
  derived and/or modified sequence opt4 from neuraminidase__InfluenzaA__AFN19933

SEQ ID NO: 175614 - RNA, 1410 nt, Artificial Sequence; identical to SEQ ID NO: 173236
  derived and/or modified sequence opt4 from neuraminidase__InfluenzaA__AFN19943

SEQ ID NO: 175615 - RNA, 1410 nt, Artificial Sequence
  derived and/or modified sequence opt4 from neuraminidase__InfluenzaA__AFN19953
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagagugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucguggagaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175616 - RNA, 1410 nt, Artificial Sequence
  derived and/or modified sequence opt4 from neuraminidase__InfluenzaA__AFN19967
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaagcaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175617 - RNA, 1410 nt, Artificial Sequence
  derived and/or modified sequence opt4 from neuraminidase__InfluenzaA__AFN19973
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggcagcagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175618 - RNA, 1410 nt, Artificial Sequence; identical to SEQ ID NO: 172777
  derived and/or modified sequence opt4 from neuraminidase__InfluenzaA__AFN19979

SEQ ID NO: 175619 - RNA, 1410 nt, Artificial Sequence
  derived and/or modified sequence opt4 from neuraminidase__InfluenzaA__AFN19985
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcgugagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175620 - RNA, 1410 nt, Artificial Sequence
  derived and/or modified sequence opt4 from neuraminidase__InfluenzaA__AFN19995
augaaccccaaccagaagaucaucaccaucggcagcgugugcaugaccaucggcauggccaaccugauccugcagaucggcaacaucaucagcaucuggaucagccacagcauccagcugggcaaccagagccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175621 - RNA, 1410 nt, Artificial Sequence; identical to SEQ ID NO: 172777
  derived and/or modified sequence opt4 from neuraminidase__InfluenzaA__AFN20001

SEQ ID NO: 175622 - RNA, 1410 nt, Artificial Sequence
  derived and/or modified sequence opt4 from neuraminidase__InfluenzaA__AFN20013
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcgaccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175623 - RNA, 1410 nt, Artificial Sequence
  derived and/or modified sequence opt4 from neuraminidase__InfluenzaA__AFN20020
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggccugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175624 - RNA, 1410 nt, Artificial Sequence; identical to SEQ ID NO: 172777
  derived and/or modified sequence opt4 from neuraminidase__InfluenzaA__AFN20022

SEQ ID NO: 175625 - RNA, 1410 nt, Artificial Sequence
  derived and/or modified sequence opt4 from neuraminidase__InfluenzaA__AFN20035
augaaccccaaccagaagaucaucaccaucggcagcgugugcaugaccaucggcaucgccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175626 - RNA, 1410 nt, Artificial Sequence; identical to SEQ ID NO: 172777
  derived and/or modified sequence opt4 from neuraminidase__InfluenzaA__AFN20041

SEQ ID NO: 175627 - RNA, 1410 nt, Artificial Sequence; identical to SEQ ID NO: 172777
  derived and/or modified sequence opt4 from neuraminidase__InfluenzaA__AFN20047

SEQ ID NO: 175628 - RNA, 1410 nt, Artificial Sequence; identical to SEQ ID NO: 173600
  derived and/or modified sequence opt4 from neuraminidase__InfluenzaA__AFN20063

SEQ ID NO: 175629 - RNA, 1410 nt, Artificial Sequence
  derived and/or modified sequence opt4 from neuraminidase__InfluenzaA__AFN20077
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175630 - RNA, 1410 nt, Artificial Sequence; identical to SEQ ID NO: 172777
  derived and/or modified sequence opt4 from neuraminidase__InfluenzaA__AFN20083

SEQ ID NO: 175631 - RNA, 1410 nt, Artificial Sequence
  derived and/or modified sequence opt4 from neuraminidase__InfluenzaA__AFN20094
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaucuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaaggccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccaugggcuggagcuggcccgacggcgccgagcugcccuucaccaucgacaaguga

SEQ ID NO: 175632 - RNA, 1410 nt, Artificial Sequence; identical to SEQ ID NO: 173236
  derived and/or modified sequence opt4 from neuraminidase__InfluenzaA__AFN20100

SEQ ID NO: 175633 - RNA, 1410 nt, Artificial Sequence
  derived and/or modified sequence opt4 from neuraminidase__InfluenzaA__AFN20114
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcagccccgugagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacagcuucagcaugaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 175634 - RNA, 1410 nt, Artificial Sequence
  derived and/or modified sequence opt4 from neuraminidase__InfluenzaA__AFN20128
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucagaagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaagcaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175635 - RNA, 1410 nt, Artificial Sequence; identical to SEQ ID NO: 172777
  derived and/or modified sequence opt4 from neuraminidase__InfluenzaA__AFN87935

SEQ ID NO: 175636 - RNA, 1410 nt, Artificial Sequence
  derived and/or modified sequence opt4 from neuraminidase__InfluenzaA__AFN87937
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacagcuucagcaugaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 175637 - RNA, 1410 nt, Artificial Sequence
  derived and/or modified sequence opt4 from neuraminidase__InfluenzaA__AFN87940
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175638 - RNA, 1410 nt, Artificial Sequence; identical to SEQ ID NO: 169258
  derived and/or modified sequence opt4 from neuraminidase__InfluenzaA__AFN87942

SEQ ID NO: 175639 - RNA, 1410 nt, Artificial Sequence; identical to SEQ ID NO: 175636
  derived and/or modified sequence opt4 from neuraminidase__InfluenzaA__AFN87944

SEQ ID NO: 175640 - RNA, 1410 nt, Artificial Sequence
  derived and/or modified sequence opt4 from neuraminidase__InfluenzaA__AFN87946
augaaccccaaccagaagaucaucaccaucggcagcgugugcaugaccaucggcauggccaaccugacccugcagaucggcaacaucaucagcaucuggaucagccacagcauccagcugggcaaccagaaccagaucgagaccugcaaccagagcgugaucaacuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucgugagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgaggugaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175641 - RNA, 1410 nt, Artificial Sequence
  derived and/or modified sequence opt4 from neuraminidase__InfluenzaA__AFN87948
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaucgugggcuggagcuggcccgacggcgccgagcugcccuucaccaucgacaaguga

SEQ ID NO: 175642 - RNA, 1410 nt, Artificial Sequence
  derived and/or modified sequence opt4 from neuraminidase__InfluenzaA__AFN87950
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccugaaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175643 - RNA, 1410 nt, Artificial Sequence; identical to SEQ ID NO: 173229
  derived and/or modified sequence opt4 from neuraminidase__InfluenzaA__AFN87952

SEQ ID NO: 175644 - RNA, 1410 nt, Artificial Sequence
  derived and/or modified sequence opt4 from neuraminidase__InfluenzaA__AFN87954
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccaugggcuggagcuggcccgacggcgccgagcugcccuucaccaucgacaaguga

SEQ ID NO: 175645 - RNA, 1410 nt, Artificial Sequence
  derived and/or modified sequence opt4 from neuraminidase__InfluenzaA__AFN87956
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaacuga

SEQ ID NO: 175646 - RNA, 1410 nt, Artificial Sequence
  derived and/or modified sequence opt4 from neuraminidase__InfluenzaA__AFN87958
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgccagcagcaacggcgccaacggcgugaagggcuucagcuucaaguacggcaacggcguguggaucggcagaaccaagagcaccagcagcagaaacggcuucgagaugaucugggaccccaacggcuggaccggcaccgacaacagcuucagcaugaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 175647 - RNA, 1410 nt, Artificial Sequence
  derived and/or modified sequence opt4 from neuraminidase__InfluenzaA__AFN87960
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggaucgagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175648 - RNA, 1413 nt, Artificial Sequence
  derived and/or modified sequence opt4 from neuraminidase__InfluenzaA__AFO64805
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccaacaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175649 - RNA, 1413 nt, Artificial Sequence
  derived and/or modified sequence opt4 from neuraminidase__InfluenzaA__AFO64816
augaaccccaaccagaagaucaucaccaucggcagcaucugcauggccaucggcaucaucagccugauccugcagaucggcaacaucgugagcaucuggaucagccacagcauccagaccggcagccagaacuacaccggcaucugcaaccagagaaucaucaccuacgagaacagcaccugggugaaccagaccuacgugaacaucaacaacaccaacgugguggccggccaggacaccaccagcguggcccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaagaagaauccugagaacccaggagagcgagugcgugugcgugaacggcagcugcuucaccaucaugaccgacggccccaacaacggccccgccagcuacaagaucuucaagaucgagaagggcaaggugaccaagagcaucgagcuggacgcccccaacagccacuacgaggagugcagcugcuaccccgacgccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaugaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 175650 - RNA, 1413 nt, Artificial Sequence
  derived and/or modified sequence opt4 from neuraminidase__InfluenzaA__AFO64827
augaaccccaaccagaagaucaucaccaucggcagcaucagcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugaucgccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcaaggugaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagauucagaaagggcuucgagaugaucugggaccccaacggcuggaccgacaccgacagcgacuuccuggugaagcaggacgugguggccaugaccgacuggagcggcuacagcggcagcuucgugcagcaccccgagcugaccggccuggacugcaugagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175651 - RNA, 1413 nt, Artificial Sequence
  derived and/or modified sequence opt4 from neuraminidase__InfluenzaA__AFO64838
augaaccccaaccagaagaucaucaccaucggcagcaucagcauggccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175652 - RNA, 1413 nt, Artificial Sequence
  derived and/or modified sequence opt4 from neuraminidase__InfluenzaA__AFO64849
augaaccccaaccagaagaucaucaccaucggcagcaucagcauggccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcgugaagcaggacgugguggccaugaccgacuggagcggcuacagcggcagcuucgugcagcaccccgagcugaccggccuggacugcaugagacccugcuucuggguggagcuggugagaggcagacccagagagaacgccaccaucuggaccagcggcagcagcaucagcuucugcggcgugaacagcgacaccgccaacuggagcuggcccgacggcgccgagcugcccuucaccaucgacaaguga

SEQ ID NO: 175653 - RNA, 1413 nt, Artificial Sequence; identical to SEQ ID NO: 167488
  derived and/or modified sequence opt4 from neuraminidase__InfluenzaA__AFO64860

SEQ ID NO: 175654 - RNA, 1413 nt, Artificial Sequence
  derived and/or modified sequence opt4 from neuraminidase__InfluenzaA__AFO64871
augaaccccaaccagaagaucaucaccaucggcagcaucagcaucgccaucggcaucaucagccugauccugcagaucggcaacaucaucagcaucugggccagccacagcauccagaccggcagccagaaccacaccggcgugugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugagacaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175655 - RNA, 1413 nt, Artificial Sequence
  derived and/or modified sequence opt4 from neuraminidase__InfluenzaA__AFO64882
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175656 - RNA, 1413 nt, Artificial Sequence
  derived and/or modified sequence opt4 from neuraminidase__InfluenzaA__AFO64893
augaaccccaaccagaagaucaucaccaucggcagcaucagcguggccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcgacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagauucagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175657 - RNA, 1413 nt, Artificial Sequence
  derived and/or modified sequence opt4 from neuraminidase__InfluenzaA__AFO64904
augaaccccaaccagaagaucaucaccaucggcagcaucagcguggccaucggcaucaucagccugauccugcagaucggcaacaucaucagcaugugggccagccacagcauccagaccggcagccagaacuacaccggcaucugcaaccagagaaucaucaccuacgagaacaacaccugggugaaccagaccuacgugaacaucaacaacaccaacgugguggccggcaaggacaagaucagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 175658 - RNA, 1413 nt, Artificial Sequence
  derived and/or modified sequence opt4 from neuraminidase__InfluenzaA__AFO65019
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175659 - RNA, 1413 nt, Artificial Sequence; identical to SEQ ID NO: 168973
  derived and/or modified sequence opt4 from neuraminidase__InfluenzaA__AFO65030

SEQ ID NO: 175660 - RNA, 1413 nt, Artificial Sequence
  derived and/or modified sequence opt4 from neuraminidase__InfluenzaA__AFO65041
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175661 - RNA, 1413 nt, Artificial Sequence
  derived and/or modified sequence opt4 from neuraminidase__InfluenzaA__AFO65052
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugcaacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175662 - RNA, 1413 nt, Artificial Sequence; identical to SEQ ID NO: 167348
  derived and/or modified sequence opt4 from neuraminidase__InfluenzaA__AFO66139

SEQ ID NO: 175663 - RNA, 1413 nt, Artificial Sequence
  derived and/or modified sequence opt4 from neuraminidase__InfluenzaA__AFO66150
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagagaaucaucaccuacgagaacagaaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagaaucagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 175664 - RNA, 1413 nt, Artificial Sequence
  derived and/or modified sequence opt4 from neuraminidase__InfluenzaA__AFO66161
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaucugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 175665 - RNA, 1413 nt, Artificial Sequence
  derived and/or modified sequence opt4 from neuraminidase__InfluenzaA__AFO66172
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175666 - RNA, 1413 nt, Artificial Sequence; identical to SEQ ID NO: 167450
  derived and/or modified sequence opt4 from neuraminidase__InfluenzaA__AFO66183

SEQ ID NO: 175667 - RNA, 1413 nt, Artificial Sequence
  derived and/or modified sequence opt4 from neuraminidase__InfluenzaA__AFO66194
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacaucguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 175668 - RNA, 1410 nt, Artificial Sequence; identical to SEQ ID NO: 169075
  derived and/or modified sequence opt4 from neuraminidase__InfluenzaA__AFO66205

SEQ ID NO: 175669 - RNA, 1413 nt, Artificial Sequence; identical to SEQ ID NO: 166935
  derived and/or modified sequence opt4 from neuraminidase__InfluenzaA__AFO66216

SEQ ID NO: 175670 - RNA, 1413 nt, Artificial Sequence; identical to SEQ ID NO: 166906
  derived and/or modified sequence opt4 from neuraminidase__InfluenzaA__AFO66227

SEQ ID NO: 175671 - RNA, 1413 nt, Artificial Sequence
  derived and/or modified sequence opt4 from neuraminidase__InfluenzaA__AFO66238
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175672 - RNA, 1413 nt, Artificial Sequence
  derived and/or modified sequence opt4 from neuraminidase__InfluenzaA__AFO66249
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175673 - RNA, 1413 nt, Artificial Sequence
  derived and/or modified sequence opt4 from neuraminidase__InfluenzaA__AFP33330
augaaccccaaccagaagaucaucaccaucggcagcaucagcguggccaucggcaucaucagccugauccugcagaucggcaacaucaucagcaucugggccagccacagcauccaggccggcagccagaacuacaccggcaucugcaaccagaagaucaucaccuacgagaacagaaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuucagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 175674 - RNA, 1413 nt, Artificial Sequence
  derived and/or modified sequence opt4 from neuraminidase__InfluenzaA__AFP33331
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175675 - RNA, 1410 nt, Artificial Sequence; identical to SEQ ID NO: 173663
  derived and/or modified sequence opt4 from neuraminidase__InfluenzaA__AFQ32576

SEQ ID NO: 175676 - RNA, 1410 nt, Artificial Sequence
  derived and/or modified sequence opt4 from neuraminidase__InfluenzaA__AFQ37282
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccggcggcagcagcaucagcuucugcggcgugaacagcgacaccgugggcuggagcuggcccgacggcgccgagcugcccuucaccaucgacaaguga

SEQ ID NO: 175677 - RNA, 1410 nt, Artificial Sequence
  derived and/or modified sequence opt4 from neuraminidase__InfluenzaA__AFQ55691
augaaccccaaccagaagaucaucaccaucggcguggugaacaccacccugagcaccaucgcccugcugaucggcgugggcaaccugguguucaacaccgugauccacgagaagaucggcgaccaccagaccgugacccaccccaccaccaccacccccgccauccccaacugcagcgacaccaucaucaccuacaacaacaccaucaucaacaacaucaccaccaccaucaucaccgaggccgagagacccuucaagagcccccugccccugugccccuucagaggcuucuuccccuuccacaaggacaacgccaucagacugggcgagaacaaggacgugaucgugaccagagagcccuacgugagcugcgacaacgacaacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcaucgccuggagcagcagcagcugcuucgacggcaaggaguggaugcacgugugcaugaccggcaacgacaacgacgccagcgcccagaucaucuacgccggcaagaugaccgacagcaucaagagcuggagaaaggacauccugagaacccaggagagcgagugccagugcaucgacggcaccugcgugguggccgugaccgacggccccgccgccagcagcgccgaccacagaaucuacuggaucagagagggcaagaucaucaaguacgaggacgugcccaagaccaagauccagcaccuggaggagugcagcugcuacguggacguggacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacgugaacggcggccccggcgugaagggcuucggcuucaaggccggcaacgacguguggcugggcagaaccgugagcaccagcggcagaagcggcuucgagaucaucaaggugaccgagggcuggaucaacagccccaaccacgccaagagcaucacccagacccugaugagcaacaacgacuggagcggcuacagcggcagcuucaucaucaagaccaaggacugcuuccagcccugcuucuacguggagcugaucagaggcagacccaacaagaacgacgacgugagcuggaccagcaacagcaucgugaccuucugcggccuggacaacgagcccggcagcggcaacuggcccgacggcagcaacaucggcuucaugcccaaguga

SEQ ID NO: 175678 - RNA, 1410 nt, Artificial Sequence
  derived and/or modified sequence opt4 from neuraminidase__InfluenzaA__AFR68156
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175679 - RNA, 1410 nt, Artificial Sequence; identical to SEQ ID NO: 175678
  derived and/or modified sequence opt4 from neuraminidase__InfluenzaA__AFR68166

SEQ ID NO: 175680 - RNA, 1410 nt, Artificial Sequence
  derived and/or modified sequence opt4 from neuraminidase__InfluenzaA__AFR68176
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggccagcuggagcaaggacauccugagaacccaggagagcgagugcgugugcaucaacggcaccugcgccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175681 - RNA, 1410 nt, Artificial Sequence; identical to SEQ ID NO: 169258
  derived and/or modified sequence opt4 from neuraminidase__InfluenzaA__AFR84677

SEQ ID NO: 175682 - RNA, 1410 nt, Artificial Sequence; identical to SEQ ID NO: 170145
  derived and/or modified sequence opt4 from neuraminidase__InfluenzaA__AFR84687

SEQ ID NO: 175683 - RNA, 1410 nt, Artificial Sequence; identical to SEQ ID NO: 169248
  derived and/or modified sequence opt4 from neuraminidase__InfluenzaA__AFR84696

SEQ ID NO: 175684 - RNA, 1410 nt, Artificial Sequence; identical to SEQ ID NO: 169258
  derived and/or modified sequence opt4 from neuraminidase__InfluenzaA__AFR84706

SEQ ID NO: 175685 - RNA, 1410 nt, Artificial Sequence; identical to SEQ ID NO: 169248
  derived and/or modified sequence opt4 from neuraminidase__InfluenzaA__AFR84716

SEQ ID NO: 175686 - RNA, 1410 nt, Artificial Sequence; identical to SEQ ID NO: 169248
  derived and/or modified sequence opt4 from neuraminidase__InfluenzaA__AFR84726

SEQ ID NO: 175687 - RNA, 1410 nt, Artificial Sequence; identical to SEQ ID NO: 169248
  derived and/or modified sequence opt4 from neuraminidase__InfluenzaA__AFR84736

SEQ ID NO: 175688 - RNA, 1410 nt, Artificial Sequence; identical to SEQ ID NO: 169248
  derived and/or modified sequence opt4 from neuraminidase__InfluenzaA__AFR84746

SEQ ID NO: 175689 - RNA, 1410 nt, Artificial Sequence; identical to SEQ ID NO: 169248
  derived and/or modified sequence opt4 from neuraminidase__InfluenzaA__AFR84756

SEQ ID NO: 175690 - RNA, 1410 nt, Artificial Sequence; identical to SEQ ID NO: 169248
  derived and/or modified sequence opt4 from neuraminidase__InfluenzaA__AFR84766

SEQ ID NO: 175691 - RNA, 1410 nt, Artificial Sequence; identical to SEQ ID NO: 169248
  derived and/or modified sequence opt4 from neuraminidase__InfluenzaA__AFR84776

SEQ ID NO: 175692 - RNA, 1410 nt, Artificial Sequence; identical to SEQ ID NO: 169248
  derived and/or modified sequence opt4 from neuraminidase__InfluenzaA__AFR84786

SEQ ID NO: 175693 - RNA, 1410 nt, Artificial Sequence; identical to SEQ ID NO: 169248
  derived and/or modified sequence opt4 from neuraminidase__InfluenzaA__AFR84796

SEQ ID NO: 175694 - RNA, 1410 nt, Artificial Sequence; identical to SEQ ID NO: 169258
  derived and/or modified sequence opt4 from neuraminidase__InfluenzaA__AFR84806

SEQ ID NO: 175695 - RNA, 1410 nt, Artificial Sequence; identical to SEQ ID NO: 169248
  derived and/or modified sequence opt4 from neuraminidase__InfluenzaA__AFR84816

SEQ ID NO: 175696 - RNA, 1410 nt, Artificial Sequence; identical to SEQ ID NO: 169258
  derived and/or modified sequence opt4 from neuraminidase__InfluenzaA__AFR84826

SEQ ID NO: 175697 - RNA, 1410 nt, Artificial Sequence
  derived and/or modified sequence opt4 from neuraminidase__InfluenzaA__AFR84836
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugggcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175698 - RNA, 1410 nt, Artificial Sequence; identical to SEQ ID NO: 170062
  derived and/or modified sequence opt4 from neuraminidase__InfluenzaA__AFR84846

SEQ ID NO: 175699 - RNA, 1410 nt, Artificial Sequence; identical to SEQ ID NO: 169258
  derived and/or modified sequence opt4 from neuraminidase__InfluenzaA__AFR84856

SEQ ID NO: 175700 - RNA, 1410 nt, Artificial Sequence
  derived and/or modified sequence opt4 from neuraminidase__InfluenzaA__AFR84866
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuucagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175701 - RNA, 1410 nt, Artificial Sequence; identical to SEQ ID NO: 169966
  derived and/or modified sequence opt4 from neuraminidase__InfluenzaA__AFR84876

SEQ ID NO: 175702 - RNA, 1410 nt, Artificial Sequence; identical to SEQ ID NO: 170062
  derived and/or modified sequence opt4 from neuraminidase__InfluenzaA__AFR84895

SEQ ID NO: 175703 - RNA, 1410 nt, Artificial Sequence; identical to SEQ ID NO: 170062
  derived and/or modified sequence opt4 from neuraminidase__InfluenzaA__AFR84905

SEQ ID NO: 175704 - RNA, 1410 nt, Artificial Sequence; identical to SEQ ID NO: 170062
  derived and/or modified sequence opt4 from neuraminidase__InfluenzaA__AFR84915

SEQ ID NO: 175705 - RNA, 1410 nt, Artificial Sequence; identical to SEQ ID NO: 170062
  derived and/or modified sequence opt4 from neuraminidase__InfluenzaA__AFR84925

SEQ ID NO: 175706 - RNA, 1353 nt, Artificial Sequence
  derived and/or modified sequence opt4 from neuraminidase__InfluenzaA__AFU83119
augaaccccaaccagaagaucaucaccaucggcagcgugagccugaccaucgccaccgugugcuuccugaugcagaucgccauccuggccaccaccgugacccugcacuucaagcagaacgagugcagcauccccagcagcaaccagguggugcccugcgagcccaucaucguggagagaaacgugaccgaguacagagacuggagcaagccccagugccagaucaccggcuucgcccccuucagcaaggacaacagcaucagacugagcgccggcggcgacaucugggugaccagagagcccuacgugagcugcagccccgacaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacgugugcgugaccggcgacgacagaaacgccaccgccagcuucaucuacgacggcgugcugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacgugagcccccugagcggcagcgcccagcacaucgaggagugcagcugcuaccccagauaccccgacgugagaugcgugugcagagacaacuggaagggcagcaacagacccaucaucgacaucagcauggccgacuacggcaucgacagcagcuacgugugcagcggccuggugggcgacacccccagaaacgacgacagcagcagcaacagcaacugcaaggaccccaacaacgagagaggcaaccccggcgugaagggcugggccuucgacuacggcaacgacguguggaugggcagaaccaucagcaaggacagcagaagcggcuacgagaccuucagagugaucggcggcuggaccaucgccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucguggccuucugcggcaccagcggcaccuacggcaccggcagcuggcccgacggcgccaacaucaacuucaugcccaucuga

SEQ ID NO: 175707 - RNA, 1410 nt, Artificial Sequence
  derived and/or modified sequence opt4 from neuraminidase__InfluenzaA__AFV53208
augaaccccaaccagaagaucaucaccaucggcagcgugagccugaccaucgccaccgugugcuuccugauccagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugauggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 175708 - RNA, 1410 nt, Artificial Sequence
  derived and/or modified sequence opt4 from neuraminidase__InfluenzaA__AFV53219
augaaccccaaccagaagaccaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggagagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 175709 - RNA, 1410 nt, Artificial Sequence
  derived and/or modified sequence opt4 from neuraminidase__InfluenzaA__AFV53230
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugguggacaucagcauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaaccugaugcccaucuga

SEQ ID NO: 175710 - RNA, 1410 nt, Artificial Sequence; identical to SEQ ID NO: 168925
  derived and/or modified sequence opt4 from neuraminidase__InfluenzaA__AFV53241

SEQ ID NO: 175711 - RNA, 1410 nt, Artificial Sequence; identical to SEQ ID NO: 166611
  derived and/or modified sequence opt4 from neuraminidase__InfluenzaA__AFV53252

SEQ ID NO: 175712 - RNA, 1413 nt, Artificial Sequence
  derived and/or modified sequence opt4 from neuraminidase__InfluenzaA__AFV53263
augaaccccaaccagaagaucaucaccaucggcagcaucugcauggccaucggcaccaucagccugauccugcagaucggcaacaucaucagcaucuggaucagccacagcauccagaccggcagccagaaccacaccggcaucugcaaccagagaaucaucaccuacgagaacaacaccugggugaaccagaccuacgugaacaucagcaacaccaacgugguggccggcaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaucaucaagagcuggagaaagcagauccugagaacccaggagagcgagugcgugugcgugaacggcagcugcuucaccaucaugaccgacggccccagcaacagacccgccagcuacagaaucuucaagaucgagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccaacaccgacggcaacuucagcgugaagcaggacgugguggccaugaccgacuggagcggcuacagcggcagcuucgugcagcaccccgagcugaccggccuggacugcaucagacccugcuucuggguggagcugaucagaggcagacccagagaggagaccaccaucuggaccagcggcagcagcaucagcuucugcggcgugaacagcgacaccgugaacuggagcuggcccgacggcgccgagcugcccuucaccaucgacaaguga

SEQ ID NO: 175713 - RNA, 1410 nt, Artificial Sequence
  derived and/or modified sequence opt4 from neuraminidase__InfluenzaA__AFV53274
augaaccccaaccagaagaucaucaccaucggcagcgugagccugaucaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 175714 - RNA, 1410 nt, Artificial Sequence
  derived and/or modified sequence opt4 from neuraminidase__InfluenzaA__AFV53285
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagacaccccgacgugagaugcaucugcagagacaacuggaagggcagcaacagacccgugaucaacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 175715 - RNA, 1410 nt, Artificial Sequence
  derived and/or modified sequence opt4 from neuraminidase__InfluenzaA__AFV53296
augaaccccaaccagaagaucaucaucaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccagcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 175716 - RNA, 1410 nt, Artificial Sequence
  derived and/or modified sequence opt4 from neuraminidase__InfluenzaA__AFV53307
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 175717 - RNA, 1410 nt, Artificial Sequence
  derived and/or modified sequence opt4 from neuraminidase__InfluenzaA__AFV53317
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaagcccccacagaacccugcugaugaacgagcugggcgugcccuuccaccugggcaccaagcaggugugcgccgccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucggcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 175718 - RNA, 1410 nt, Artificial Sequence
  derived and/or modified sequence opt4 from neuraminidase__InfluenzaA__AFV53328
augaaccccaaccagaagaucaucaccaucggcagcgugagccugaccaucgccaccgugugcuuccugaugcacaucgccauccuggccaccaccgugacccugcacuucaagcagcacgagugcgacagccccgccagcaaccaggccaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcaucaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 175719 - RNA, 1410 nt, Artificial Sequence
  derived and/or modified sequence opt4 from neuraminidase__InfluenzaA__AFV53339
augaaccccaaccagaagaucaucaccaucggcagcgccagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaugagcccccugagcggcagcgcccagcacguggaggagugcagcugcuaccccagauaccccgacgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagaagggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaaccugaugcccaucuga

SEQ ID NO: 175720 - RNA, 1410 nt, Artificial Sequence; identical to SEQ ID NO: 169258
  derived and/or modified sequence opt4 from neuraminidase__InfluenzaA__AFX96367

SEQ ID NO: 175721 - RNA, 1410 nt, Artificial Sequence; identical to SEQ ID NO: 169258
  derived and/or modified sequence opt4 from neuraminidase__InfluenzaA__AFX96386

SEQ ID NO: 175722 - RNA, 1410 nt, Artificial Sequence; identical to SEQ ID NO: 169612
  derived and/or modified sequence opt4 from neuraminidase__InfluenzaA__AFX96401

SEQ ID NO: 175723 - RNA, 1410 nt, Artificial Sequence; identical to SEQ ID NO: 169612
  derived and/or modified sequence opt4 from neuraminidase__InfluenzaA__AFX96411

SEQ ID NO: 175724 - RNA, 1410 nt, Artificial Sequence; identical to SEQ ID NO: 169612
  derived and/or modified sequence opt4 from neuraminidase__InfluenzaA__AFX96421

SEQ ID NO: 175725 - RNA, 1410 nt, Artificial Sequence; identical to SEQ ID NO: 169612
  derived and/or modified sequence opt4 from neuraminidase__InfluenzaA__AFX96431

SEQ ID NO: 175726 - RNA, 1410 nt, Artificial Sequence; identical to SEQ ID NO: 169612
  derived and/or modified sequence opt4 from neuraminidase__InfluenzaA__AFX96441

SEQ ID NO: 175727 - RNA, 1410 nt, Artificial Sequence; identical to SEQ ID NO: 169612
  derived and/or modified sequence opt4 from neuraminidase__InfluenzaA__AFX96451

SEQ ID NO: 175728 - RNA, 1410 nt, Artificial Sequence; identical to SEQ ID NO: 169612
  derived and/or modified sequence opt4 from neuraminidase__InfluenzaA__AFX96461

SEQ ID NO: 175729 - RNA, 1410 nt, Artificial Sequence; identical to SEQ ID NO: 169258
  derived and/or modified sequence opt4 from neuraminidase__InfluenzaA__AFX96471

SEQ ID NO: 175730 - RNA, 1410 nt, Artificial Sequence; identical to SEQ ID NO: 169258
  derived and/or modified sequence opt4 from neuraminidase__InfluenzaA__AFX96481

SEQ ID NO: 175731 - RNA, 1410 nt, Artificial Sequence; identical to SEQ ID NO: 169258
  derived and/or modified sequence opt4 from neuraminidase__InfluenzaA__AFX96491

SEQ ID NO: 175732 - RNA, 1410 nt, Artificial Sequence; identical to SEQ ID NO: 169258
  derived and/or modified sequence opt4 from neuraminidase__InfluenzaA__AFX96501

SEQ ID NO: 175733 - RNA, 1410 nt, Artificial Sequence; identical to SEQ ID NO: 169258
  derived and/or modified sequence opt4 from neuraminidase__InfluenzaA__AFX96511

SEQ ID NO: 175734 - RNA, 1410 nt, Artificial Sequence
  derived and/or modified sequence opt4 from neuraminidase__InfluenzaA__AFX96521
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccagacagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175735 - RNA, 1410 nt, Artificial Sequence; identical to SEQ ID NO: 169258
  derived and/or modified sequence opt4 from neuraminidase__InfluenzaA__AFX96531

SEQ ID NO: 175736 - RNA, 1410 nt, Artificial Sequence; identical to SEQ ID NO: 169258
  derived and/or modified sequence opt4 from neuraminidase__InfluenzaA__AFX96541

SEQ ID NO: 175737 - RNA, 1410 nt, Artificial Sequence; identical to SEQ ID NO: 169258
  derived and/or modified sequence opt4 from neuraminidase__InfluenzaA__AFX96551

SEQ ID NO: 175738 - RNA, 1410 nt, Artificial Sequence; identical to SEQ ID NO: 173782
  derived and/or modified sequence opt4 from neuraminidase__InfluenzaA__AFX96561

SEQ ID NO: 175739 - RNA, 1410 nt, Artificial Sequence; identical to SEQ ID NO: 169258
  derived and/or modified sequence opt4 from neuraminidase__InfluenzaA__AFX96571

SEQ ID NO: 175740 - RNA, 1410 nt, Artificial Sequence; identical to SEQ ID NO: 169258
  derived and/or modified sequence opt4 from neuraminidase__InfluenzaA__AFX96581

SEQ ID NO: 175741 - RNA, 1410 nt, Artificial Sequence; identical to SEQ ID NO: 169258
  derived and/or modified sequence opt4 from neuraminidase__InfluenzaA__AFX96591

SEQ ID NO: 175742 - RNA, 1410 nt, Artificial Sequence; identical to SEQ ID NO: 169258
  derived and/or modified sequence opt4 from neuraminidase__InfluenzaA__AFX96601

SEQ ID NO: 175743 - RNA, 1410 nt, Artificial Sequence; identical to SEQ ID NO: 169258
  derived and/or modified sequence opt4 from neuraminidase__InfluenzaA__AFX96611

SEQ ID NO: 175744 - RNA, 1410 nt, Artificial Sequence; identical to SEQ ID NO: 169258
  derived and/or modified sequence opt4 from neuraminidase__InfluenzaA__AFX96621

SEQ ID NO: 175745 - RNA, 1410 nt, Artificial Sequence; identical to SEQ ID NO: 169258
  derived and/or modified sequence opt4 from neuraminidase__InfluenzaA__AFX96631

SEQ ID NO: 175746 - RNA, 1410 nt, Artificial Sequence
  derived and/or modified sequence opt4 from neuraminidase__InfluenzaA__AFX96641
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcaaguucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175747 - RNA, 1410 nt, Artificial Sequence; identical to SEQ ID NO: 169258
  derived and/or modified sequence opt4 from neuraminidase__InfluenzaA__AFX96651

SEQ ID NO: 175748 - RNA, 1410 nt, Artificial Sequence; identical to SEQ ID NO: 169258
  derived and/or modified sequence opt4 from neuraminidase__InfluenzaA__AFX96661

SEQ ID NO: 175749 - RNA, 1410 nt, Artificial Sequence; identical to SEQ ID NO: 169258
  derived and/or modified sequence opt4 from neuraminidase__InfluenzaA__AFX96671

SEQ ID NO: 175750 - RNA, 1410 nt, Artificial Sequence; identical to SEQ ID NO: 169258
  derived and/or modified sequence opt4 from neuraminidase__InfluenzaA__AFX96681

SEQ ID NO: 175751 - RNA, 1410 nt, Artificial Sequence; identical to SEQ ID NO: 169258
  derived and/or modified sequence opt4 from neuraminidase__InfluenzaA__AFX96691

SEQ ID NO: 175752 - RNA, 1410 nt, Artificial Sequence
  derived and/or modified sequence opt4 from neuraminidase__InfluenzaA__AFX96701
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcaucaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcuucaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 175753 - RNA, 1410 nt, Artificial Sequence; identical to SEQ ID NO: 169258
  derived and/or modified sequence opt4 from neuraminidase__InfluenzaA__AFX96711

SEQ ID NO: 175754 - RNA, 1410 nt, Artificial Sequence
  derived and/or modified sequence opt4 from neuraminidase__InfluenzaA__AFX96721
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 175755 - RNA, 1410 nt, Artificial Sequence; identical to SEQ ID NO: 175754
  derived and/or modified sequence opt4 from neuraminidase__InfluenzaA__AFX96731

SEQ ID NO: 175756 - RNA, 1410 nt, Artificial Sequence; identical to SEQ ID NO: 169258
  derived and/or modified sequence opt4 from neuraminidase__InfluenzaA__AFX96741

SEQ ID NO: 175757 - RNA, 1410 nt, Artificial Sequence; identical to SEQ ID NO: 169258
  derived and/or modified sequence opt4 from neuraminidase__InfluenzaA__AFX96751

SEQ ID NO: 175758 - RNA, 1410 nt, Artificial Sequence; identical to SEQ ID NO: 170276
  derived and/or modified sequence opt4 from neuraminidase__InfluenzaA__AFX96761

SEQ ID NO: 175759 - RNA, 1410 nt, Artificial Sequence; identical to SEQ ID NO: 169258
  derived and/or modified sequence opt4 from neuraminidase__InfluenzaA__AFX96771

SEQ ID NO: 175760 - RNA, 1410 nt, Artificial Sequence
  derived and/or modified sequence opt4 from neuraminidase__InfluenzaA__AFX96791
augaaccccaaccagaagaucaucaccaucggcagcgugugcaugaccaucggcauggccaaccugauccugcaggugggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcaucaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175761 - RNA, 1410 nt, Artificial Sequence; identical to SEQ ID NO: 175760
  derived and/or modified sequence opt4 from neuraminidase__InfluenzaA__AFX96801

SEQ ID NO: 175762 - RNA, 1410 nt, Artificial Sequence
  derived and/or modified sequence opt4 from neuraminidase__InfluenzaA__AFX96811
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugagacuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175763 - RNA, 1410 nt, Artificial Sequence; identical to SEQ ID NO: 169258
  derived and/or modified sequence opt4 from neuraminidase__InfluenzaA__AFX96821

SEQ ID NO: 175764 - RNA, 1410 nt, Artificial Sequence; identical to SEQ ID NO: 175760
  derived and/or modified sequence opt4 from neuraminidase__InfluenzaA__AFX96831

SEQ ID NO: 175765 - RNA, 1410 nt, Artificial Sequence
  derived and/or modified sequence opt4 from neuraminidase__InfluenzaA__AFX96841
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugagacuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175766 - RNA, 1410 nt, Artificial Sequence; identical to SEQ ID NO: 169258
  derived and/or modified sequence opt4 from neuraminidase__InfluenzaA__AFX96859

SEQ ID NO: 175767 - RNA, 1410 nt, Artificial Sequence; identical to SEQ ID NO: 169258
  derived and/or modified sequence opt4 from neuraminidase__InfluenzaA__AFX96907

SEQ ID NO: 175768 - RNA, 1410 nt, Artificial Sequence; identical to SEQ ID NO: 169258
  derived and/or modified sequence opt4 from neuraminidase__InfluenzaA__AFX96917

SEQ ID NO: 175769 - RNA, 1410 nt, Artificial Sequence; identical to SEQ ID NO: 169258
  derived and/or modified sequence opt4 from neuraminidase__InfluenzaA__AFX96927

SEQ ID NO: 175770 - RNA, 1410 nt, Artificial Sequence
  derived and/or modified sequence opt4 from neuraminidase__InfluenzaA__AFX96937
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcagcaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175771 - RNA, 1410 nt, Artificial Sequence; identical to SEQ ID NO: 169248
  derived and/or modified sequence opt4 from neuraminidase__InfluenzaA__AFY23991

SEQ ID NO: 175772 - RNA, 1410 nt, Artificial Sequence; identical to SEQ ID NO: 169258
  derived and/or modified sequence opt4 from neuraminidase__InfluenzaA__AFY24001

SEQ ID NO: 175773 - RNA, 1410 nt, Artificial Sequence; identical to SEQ ID NO: 169258
  derived and/or modified sequence opt4 from neuraminidase__InfluenzaA__AFY24022

SEQ ID NO: 175774 - RNA, 1410 nt, Artificial Sequence; identical to SEQ ID NO: 169258
  derived and/or modified sequence opt4 from neuraminidase__InfluenzaA__AFY24043

SEQ ID NO: 175775 - RNA, 1410 nt, Artificial Sequence
  derived and/or modified sequence opt4 from neuraminidase__InfluenzaA__AFY24153
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaccgacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175776 - RNA, 1410 nt, Artificial Sequence
  derived and/or modified sequence opt4 from neuraminidase__InfluenzaA__AFY24208
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagagacugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 175777 - RNA, 1410 nt, Artificial Sequence; identical to SEQ ID NO: 168449
  derived and/or modified sequence opt4 from neuraminidase__InfluenzaA__AFY24219

SEQ ID NO: 175778 - RNA, 1410 nt, Artificial Sequence
  derived and/or modified sequence opt4 from neuraminidase__InfluenzaA__AGB12978
augaaccccaaccagagaaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccagacagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175779 - RNA, 1410 nt, Artificial Sequence; identical to SEQ ID NO: 172777
  derived and/or modified sequence opt4 from neuraminidase__InfluenzaA__AGB12989

SEQ ID NO: 175780 - RNA, 1410 nt, Artificial Sequence; identical to SEQ ID NO: 173229
  derived and/or modified sequence opt4 from neuraminidase__InfluenzaA__AGB13009

SEQ ID NO: 175781 - RNA, 1410 nt, Artificial Sequence; identical to SEQ ID NO: 173229
  derived and/or modified sequence opt4 from neuraminidase__InfluenzaA__AGB13019

SEQ ID NO: 175782 - RNA, 1410 nt, Artificial Sequence; identical to SEQ ID NO: 173229
  derived and/or modified sequence opt4 from neuraminidase__InfluenzaA__AGB13029

SEQ ID NO: 175783 - RNA, 1410 nt, Artificial Sequence; identical to SEQ ID NO: 173478
  derived and/or modified sequence opt4 from neuraminidase__InfluenzaA__AGB13039

SEQ ID NO: 175784 - RNA, 1410 nt, Artificial Sequence; identical to SEQ ID NO: 173229
  derived and/or modified sequence opt4 from neuraminidase__InfluenzaA__AGB13051

SEQ ID NO: 175785 - RNA, 1410 nt, Artificial Sequence
  derived and/or modified sequence opt4 from neuraminidase__InfluenzaA__AGB13069
augaaccccaaccagaagaucaucaccaucggcagcaucugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccuggaucagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175786 - RNA, 1410 nt, Artificial Sequence
  derived and/or modified sequence opt4 from neuraminidase__InfluenzaA__AGB13074
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175787 - RNA, 1410 nt, Artificial Sequence
  derived and/or modified sequence opt4 from neuraminidase__InfluenzaA__AGB13115
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugcugagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggagaggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175788 - RNA, 1410 nt, Artificial Sequence; identical to SEQ ID NO: 173229
  derived and/or modified sequence opt4 from neuraminidase__InfluenzaA__AGB13133

SEQ ID NO: 175789 - RNA, 1410 nt, Artificial Sequence; identical to SEQ ID NO: 172777
  derived and/or modified sequence opt4 from neuraminidase__InfluenzaA__AGB13152

SEQ ID NO: 175790 - RNA, 1410 nt, Artificial Sequence; identical to SEQ ID NO: 172777
  derived and/or modified sequence opt4 from neuraminidase__InfluenzaA__AGB13162

SEQ ID NO: 175791 - RNA, 1410 nt, Artificial Sequence; identical to SEQ ID NO: 173600
  derived and/or modified sequence opt4 from neuraminidase__InfluenzaA__AGB13173

SEQ ID NO: 175792 - RNA, 1410 nt, Artificial Sequence
  derived and/or modified sequence opt4 from neuraminidase__InfluenzaA__AGB13183
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccaggacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175793 - RNA, 1410 nt, Artificial Sequence; identical to SEQ ID NO: 173229
  derived and/or modified sequence opt4 from neuraminidase__InfluenzaA__AGB13193

SEQ ID NO: 175794 - RNA, 1410 nt, Artificial Sequence; identical to SEQ ID NO: 173296
  derived and/or modified sequence opt4 from neuraminidase__InfluenzaA__AGB13203

SEQ ID NO: 175795 - RNA, 1410 nt, Artificial Sequence; identical to SEQ ID NO: 173229
  derived and/or modified sequence opt4 from neuraminidase__InfluenzaA__AGB13213

SEQ ID NO: 175796 - RNA, 1410 nt, Artificial Sequence; identical to SEQ ID NO: 173229
  derived and/or modified sequence opt4 from neuraminidase__InfluenzaA__AGB13223

SEQ ID NO: 175797 - RNA, 1410 nt, Artificial Sequence; identical to SEQ ID NO: 173229
  derived and/or modified sequence opt4 from neuraminidase__InfluenzaA__AGB13233

SEQ ID NO: 175798 - RNA, 1410 nt, Artificial Sequence
  derived and/or modified sequence opt4 from neuraminidase__InfluenzaA__AGB13243
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagagaggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175799 - RNA, 1410 nt, Artificial Sequence; identical to SEQ ID NO: 173296
  derived and/or modified sequence opt4 from neuraminidase__InfluenzaA__AGB13253

SEQ ID NO: 175800 - RNA, 1410 nt, Artificial Sequence
  derived and/or modified sequence opt4 from neuraminidase__InfluenzaA__AGB13263
augaaccccaaccagaagaucaucaccaucggcagcgugugcaugaccaucggcauggccaaccugauccugcagaucggcaacaucaucagcaucuggaucagccacagcauccagcugggcaaccagaaccagaccgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccguggacaaguga

SEQ ID NO: 175801 - RNA, 1410 nt, Artificial Sequence; identical to SEQ ID NO: 173229
  derived and/or modified sequence opt4 from neuraminidase__InfluenzaA__AGB13273

SEQ ID NO: 175802 - RNA, 1410 nt, Artificial Sequence
  derived and/or modified sequence opt4 from neuraminidase__InfluenzaA__AGB13283
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaagaggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175803 - RNA, 1410 nt, Artificial Sequence; identical to SEQ ID NO: 173229
  derived and/or modified sequence opt4 from neuraminidase__InfluenzaA__AGB13293

SEQ ID NO: 175804 - RNA, 1410 nt, Artificial Sequence; identical to SEQ ID NO: 173229
  derived and/or modified sequence opt4 from neuraminidase__InfluenzaA__AGB13303

SEQ ID NO: 175805 - RNA, 1410 nt, Artificial Sequence
  derived and/or modified sequence opt4 from neuraminidase__InfluenzaA__AGB13313
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgccaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175806 - RNA, 1410 nt, Artificial Sequence; identical to SEQ ID NO: 173229
  derived and/or modified sequence opt4 from neuraminidase__InfluenzaA__AGB13323

SEQ ID NO: 175807 - RNA, 1410 nt, Artificial Sequence
  derived and/or modified sequence opt4 from neuraminidase__InfluenzaA__AGB13333
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcgccgugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175808 - RNA, 1410 nt, Artificial Sequence; identical to SEQ ID NO: 173229
  derived and/or modified sequence opt4 from neuraminidase__InfluenzaA__AGB13343

SEQ ID NO: 175809 - RNA, 1410 nt, Artificial Sequence; identical to SEQ ID NO: 173478
  derived and/or modified sequence opt4 from neuraminidase__InfluenzaA__AGB13353

SEQ ID NO: 175810 - RNA, 1410 nt, Artificial Sequence
  derived and/or modified sequence opt4 from neuraminidase__InfluenzaA__AGB13363
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugcagcgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175811 - RNA, 1410 nt, Artificial Sequence
  derived and/or modified sequence opt4 from neuraminidase__InfluenzaA__AGB13383
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcagcggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175812 - RNA, 1410 nt, Artificial Sequence; identical to SEQ ID NO: 172777
  derived and/or modified sequence opt4 from neuraminidase__InfluenzaA__AGB13393

SEQ ID NO: 175813 - RNA, 1410 nt, Artificial Sequence; identical to SEQ ID NO: 173477
  derived and/or modified sequence opt4 from neuraminidase__InfluenzaA__AGB13403

SEQ ID NO: 175814 - RNA, 1410 nt, Artificial Sequence; identical to SEQ ID NO: 172777
  derived and/or modified sequence opt4 from neuraminidase__InfluenzaA__AGB13413

SEQ ID NO: 175815 - RNA, 1410 nt, Artificial Sequence; identical to SEQ ID NO: 172777
  derived and/or modified sequence opt4 from neuraminidase__InfluenzaA__AGB13423

SEQ ID NO: 175816 - RNA, 1410 nt, Artificial Sequence; identical to SEQ ID NO: 173477
  derived and/or modified sequence opt4 from neuraminidase__InfluenzaA__AGB13433

SEQ ID NO: 175817 - RNA, 1410 nt, Artificial Sequence; identical to SEQ ID NO: 173477
  derived and/or modified sequence opt4 from neuraminidase__InfluenzaA__AGB13443

SEQ ID NO: 175818 - RNA, 1410 nt, Artificial Sequence
  derived and/or modified sequence opt4 from neuraminidase__InfluenzaA__AGB13453
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcuucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175819 - RNA, 1410 nt, Artificial Sequence; identical to SEQ ID NO: 172777
  derived and/or modified sequence opt4 from neuraminidase__InfluenzaA__AGB13463

SEQ ID NO: 175820 - RNA, 1410 nt, Artificial Sequence; identical to SEQ ID NO: 173229
  derived and/or modified sequence opt4 from neuraminidase__InfluenzaA__AGB13473

SEQ ID NO: 175821 - RNA, 1410 nt, Artificial Sequence
  derived and/or modified sequence opt4 from neuraminidase__InfluenzaA__AGB13483
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggccagcccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175822 - RNA, 1410 nt, Artificial Sequence; identical to SEQ ID NO: 173514
  derived and/or modified sequence opt4 from neuraminidase__InfluenzaA__AGB13493

SEQ ID NO: 175823 - RNA, 1410 nt, Artificial Sequence; identical to SEQ ID NO: 173306
  derived and/or modified sequence opt4 from neuraminidase__InfluenzaA__AGB13503

SEQ ID NO: 175824 - RNA, 1410 nt, Artificial Sequence; identical to SEQ ID NO: 170720
  derived and/or modified sequence opt4 from neuraminidase__InfluenzaA__AGB13513

SEQ ID NO: 175825 - RNA, 1410 nt, Artificial Sequence; identical to SEQ ID NO: 173512
  derived and/or modified sequence opt4 from neuraminidase__InfluenzaA__AGB13523

SEQ ID NO: 175826 - RNA, 1410 nt, Artificial Sequence; identical to SEQ ID NO: 173512
  derived and/or modified sequence opt4 from neuraminidase__InfluenzaA__AGB13533

SEQ ID NO: 175827 - RNA, 1410 nt, Artificial Sequence; identical to SEQ ID NO: 173229
  derived and/or modified sequence opt4 from neuraminidase__InfluenzaA__AGB13543

SEQ ID NO: 175828 - RNA, 1410 nt, Artificial Sequence; identical to SEQ ID NO: 173229
  derived and/or modified sequence opt4 from neuraminidase__InfluenzaA__AGB13553

SEQ ID NO: 175829 - RNA, 1410 nt, Artificial Sequence
  derived and/or modified sequence opt4 from neuraminidase__InfluenzaA__AGB13563
augaaccccaaccagaagaucaucaccaucggcagcgugugcaugaccaucggcguggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaaccuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagaacaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175830 - RNA, 1410 nt, Artificial Sequence; identical to SEQ ID NO: 173229
  derived and/or modified sequence opt4 from neuraminidase__InfluenzaA__AGB13573

SEQ ID NO: 175831 - RNA, 1410 nt, Artificial Sequence
  derived and/or modified sequence opt4 from neuraminidase__InfluenzaA__AGB13583
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcgugggcagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175832 - RNA, 1410 nt, Artificial Sequence; identical to SEQ ID NO: 173229
  derived and/or modified sequence opt4 from neuraminidase__InfluenzaA__AGB13593

SEQ ID NO: 175833 - RNA, 1410 nt, Artificial Sequence; identical to SEQ ID NO: 173229
  derived and/or modified sequence opt4 from neuraminidase__InfluenzaA__AGB13603

SEQ ID NO: 175834 - RNA, 1410 nt, Artificial Sequence; identical to SEQ ID NO: 173229
  derived and/or modified sequence opt4 from neuraminidase__InfluenzaA__AGB13613

SEQ ID NO: 175835 - RNA, 1410 nt, Artificial Sequence; identical to SEQ ID NO: 173229
  derived and/or modified sequence opt4 from neuraminidase__InfluenzaA__AGB13623

SEQ ID NO: 175836 - RNA, 1410 nt, Artificial Sequence
  derived and/or modified sequence opt4 from neuraminidase__InfluenzaA__AGB13633
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 175837 - RNA, 1410 nt, Artificial Sequence
  derived and/or modified sequence opt4 from neuraminidase__InfluenzaA__AGB13643
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacggcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcgugaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175838 - RNA, 1410 nt, Artificial Sequence
  derived and/or modified sequence opt4 from neuraminidase__InfluenzaA__AGB13653
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcgugaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175839 - RNA, 1410 nt, Artificial Sequence; identical to SEQ ID NO: 172777
  derived and/or modified sequence opt4 from neuraminidase__InfluenzaA__AGB13663

SEQ ID NO: 175840 - RNA, 1410 nt, Artificial Sequence; identical to SEQ ID NO: 172777
  derived and/or modified sequence opt4 from neuraminidase__InfluenzaA__AGB13724

SEQ ID NO: 175841 - RNA, 1410 nt, Artificial Sequence; identical to SEQ ID NO: 173229
  derived and/or modified sequence opt4 from neuraminidase__InfluenzaA__AGB13734

SEQ ID NO: 175842 - RNA, 1410 nt, Artificial Sequence; identical to SEQ ID NO: 169734
  derived and/or modified sequence opt4 from neuraminidase__InfluenzaA__AGB51359

SEQ ID NO: 175843 - RNA, 1410 nt, Artificial Sequence
  derived and/or modified sequence opt4 from neuraminidase__InfluenzaA__AGB97270
augaaccccaaccagaagaucaucaccaucggcagcgugugcaugaccaucggcauggccaaccugauccugcagaucggcaacaucaucagcaucuggaucagccacagcauccagcugagaaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccauggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175844 - RNA, 1410 nt, Artificial Sequence
  derived and/or modified sequence opt4 from neuraminidase__InfluenzaA__AGB97274
augaaccccaaccagaagaucaucaccaucggcagcgugugcaugaccaucggcauggccaaccugauccugcagaucggcaacaucaucagcaucuggaucagccacagcauccagcugagaaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175845 - RNA, 1410 nt, Artificial Sequence; identical to SEQ ID NO: 174666
  derived and/or modified sequence opt4 from neuraminidase__InfluenzaA__AGB97289

SEQ ID NO: 175846 - RNA, 1410 nt, Artificial Sequence
  derived and/or modified sequence opt4 from neuraminidase__InfluenzaA__AGE15475
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcagccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacuacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucagcaucgacaaguga

SEQ ID NO: 175847 - RNA, 1410 nt, Artificial Sequence
  derived and/or modified sequence opt4 from neuraminidase__InfluenzaA__AGE15476
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcagccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacuacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175848 - RNA, 1410 nt, Artificial Sequence; identical to SEQ ID NO: 175678
  derived and/or modified sequence opt4 from neuraminidase__InfluenzaA__AGE15477

SEQ ID NO: 175849 - RNA, 1410 nt, Artificial Sequence
  derived and/or modified sequence opt4 from neuraminidase__InfluenzaA__AGE15478
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcagccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacuacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaagagcgacaccgugggcuggagcuggcccgacggcgccgagcugcccuucaccaucgacaaguga

SEQ ID NO: 175850 - RNA, 1410 nt, Artificial Sequence
  derived and/or modified sequence opt4 from neuraminidase__InfluenzaA__AGE15479
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcagccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccaucgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacuacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175851 - RNA, 1410 nt, Artificial Sequence; identical to SEQ ID NO: 175678
  derived and/or modified sequence opt4 from neuraminidase__InfluenzaA__AGE15480

SEQ ID NO: 175852 - RNA, 1410 nt, Artificial Sequence; identical to SEQ ID NO: 170720
  derived and/or modified sequence opt4 from neuraminidase__InfluenzaA__AGE89270

SEQ ID NO: 175853 - RNA, 1410 nt, Artificial Sequence; identical to SEQ ID NO: 170720
  derived and/or modified sequence opt4 from neuraminidase__InfluenzaA__AGE89280

SEQ ID NO: 175854 - RNA, 1410 nt, Artificial Sequence
  derived and/or modified sequence opt4 from neuraminidase__InfluenzaA__AGE89290
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaucguggugaugaccgacggcagcgccagcggcaaggccgacaccaagauccuguucguggaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucaucagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175855 - RNA, 1410 nt, Artificial Sequence; identical to SEQ ID NO: 172777
  derived and/or modified sequence opt4 from neuraminidase__InfluenzaA__AGE89301

SEQ ID NO: 175856 - RNA, 1410 nt, Artificial Sequence
  derived and/or modified sequence opt4 from neuraminidase__InfluenzaA__AGE89311
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggaagaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacagaaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaagaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaugagcuucugcggcgugaacagcgacaccgugggcuggagcuggcccgacggcgccgagcugcccuucaccaucgacaaguga

SEQ ID NO: 175857 - RNA, 1410 nt, Artificial Sequence; identical to SEQ ID NO: 174307
  derived and/or modified sequence opt4 from neuraminidase__InfluenzaA__AGE89321

SEQ ID NO: 175858 - RNA, 1410 nt, Artificial Sequence; identical to SEQ ID NO: 173663
  derived and/or modified sequence opt4 from neuraminidase__InfluenzaA__AGE89332

SEQ ID NO: 175859 - RNA, 1410 nt, Artificial Sequence; identical to SEQ ID NO: 172777
  derived and/or modified sequence opt4 from neuraminidase__InfluenzaA__AGE89343

SEQ ID NO: 175860 - RNA, 1410 nt, Artificial Sequence
  derived and/or modified sequence opt4 from neuraminidase__InfluenzaA__AGE89353
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaucaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175861 - RNA, 1410 nt, Artificial Sequence; identical to SEQ ID NO: 173514
  derived and/or modified sequence opt4 from neuraminidase__InfluenzaA__AGE89364

SEQ ID NO: 175862 - RNA, 1410 nt, Artificial Sequence; identical to SEQ ID NO: 174307
  derived and/or modified sequence opt4 from neuraminidase__InfluenzaA__AGE89374

SEQ ID NO: 175863 - RNA, 1410 nt, Artificial Sequence
  derived and/or modified sequence opt4 from neuraminidase__InfluenzaA__AGE89385
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175864 - RNA, 1410 nt, Artificial Sequence
  derived and/or modified sequence opt4 from neuraminidase__InfluenzaA__AGE89395
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175865 - RNA, 1410 nt, Artificial Sequence; identical to SEQ ID NO: 170720
  derived and/or modified sequence opt4 from neuraminidase__InfluenzaA__AGE89425

SEQ ID NO: 175866 - RNA, 1410 nt, Artificial Sequence; identical to SEQ ID NO: 172038
  derived and/or modified sequence opt4 from neuraminidase__InfluenzaA__AGE89722

SEQ ID NO: 175867 - RNA, 1410 nt, Artificial Sequence
  derived and/or modified sequence opt4 from neuraminidase__InfluenzaA__AGE89733
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175868 - RNA, 1410 nt, Artificial Sequence
  derived and/or modified sequence opt4 from neuraminidase__InfluenzaA__AGE89743
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaaggacaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175869 - RNA, 1410 nt, Artificial Sequence; identical to SEQ ID NO: 174307
  derived and/or modified sequence opt4 from neuraminidase__InfluenzaA__AGE89754

SEQ ID NO: 175870 - RNA, 1410 nt, Artificial Sequence; identical to SEQ ID NO: 174307
  derived and/or modified sequence opt4 from neuraminidase__InfluenzaA__AGE89765

SEQ ID NO: 175871 - RNA, 1410 nt, Artificial Sequence
  derived and/or modified sequence opt4 from neuraminidase__InfluenzaA__AGG13414
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacagcgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175872 - RNA, 1410 nt, Artificial Sequence; identical to SEQ ID NO: 174666
  derived and/or modified sequence opt4 from neuraminidase__InfluenzaA__AGG13426

SEQ ID NO: 175873 - RNA, 1410 nt, Artificial Sequence; identical to SEQ ID NO: 174666
  derived and/or modified sequence opt4 from neuraminidase__InfluenzaA__AGG13438

SEQ ID NO: 175874 - RNA, 1410 nt, Artificial Sequence
  derived and/or modified sequence opt4 from neuraminidase__InfluenzaA__AGG13498
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175875 - RNA, 1410 nt, Artificial Sequence; identical to SEQ ID NO: 174666
  derived and/or modified sequence opt4 from neuraminidase__InfluenzaA__AGG13510

SEQ ID NO: 175876 - RNA, 1410 nt, Artificial Sequence; identical to SEQ ID NO: 175874
  derived and/or modified sequence opt4 from neuraminidase__InfluenzaA__AGG13522

SEQ ID NO: 175877 - RNA, 1410 nt, Artificial Sequence
  derived and/or modified sequence opt4 from neuraminidase__InfluenzaA__AGG13534
augaaccccaaccagaagaucaucaccaucggcagcgugagccugaccaucagcaccgugugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175878 - RNA, 1410 nt, Artificial Sequence
  derived and/or modified sequence opt4 from neuraminidase__InfluenzaA__AGG13546
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175879 - RNA, 1410 nt, Artificial Sequence; identical to SEQ ID NO: 174666
  derived and/or modified sequence opt4 from neuraminidase__InfluenzaA__AGG13558

SEQ ID NO: 175880 - RNA, 1410 nt, Artificial Sequence; identical to SEQ ID NO: 174666
  derived and/or modified sequence opt4 from neuraminidase__InfluenzaA__AGG13570

SEQ ID NO: 175881 - RNA, 1410 nt, Artificial Sequence
  derived and/or modified sequence opt4 from neuraminidase__InfluenzaA__AGG13582
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgaggacaagaacgccaccgccagcuucaucuacaacggcagacugguggacagcguggugagcuggagcaaggagacccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175882 - RNA, 1410 nt, Artificial Sequence; identical to SEQ ID NO: 174666
  derived and/or modified sequence opt4 from neuraminidase__InfluenzaA__AGG13606

SEQ ID NO: 175883 - RNA, 1410 nt, Artificial Sequence
  derived and/or modified sequence opt4 from neuraminidase__InfluenzaA__AGG13618
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuaccugugcagcggccuggugggcgacacccccagaaagaacgacggcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacagaucaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175884 - RNA, 1410 nt, Artificial Sequence
  derived and/or modified sequence opt4 from neuraminidase__InfluenzaA__AGG13630
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgaggacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175885 - RNA, 1410 nt, Artificial Sequence; identical to SEQ ID NO: 174666
  derived and/or modified sequence opt4 from neuraminidase__InfluenzaA__AGG13642

SEQ ID NO: 175886 - RNA, 1410 nt, Artificial Sequence
  derived and/or modified sequence opt4 from neuraminidase__InfluenzaA__AGG13654
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcgccguggugaugaccgacggcagcgccagcggcaaggccgacaccaagauccuguucaucgaggagggcaagaucgugcagaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaucgaggugcuguggaccagcaacagcaucgugguguucugcggcaccagcggcaccuacggcaccggcagcuggcccgacggcgccgaccugaaccugaugcccaucuga

SEQ ID NO: 175887 - RNA, 1410 nt, Artificial Sequence; identical to SEQ ID NO: 175877
  derived and/or modified sequence opt4 from neuraminidase__InfluenzaA__AGG13666

SEQ ID NO: 175888 - RNA, 1410 nt, Artificial Sequence
  derived and/or modified sequence opt4 from neuraminidase__InfluenzaA__AGG13678
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgccccccugagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugggccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccgccggcaccuacggcaccggcagcuggcccgacggcgccgaccugaaccugaugcccaucuga

SEQ ID NO: 175889 - RNA, 1410 nt, Artificial Sequence; identical to SEQ ID NO: 174666
  derived and/or modified sequence opt4 from neuraminidase__InfluenzaA__AGG13690

SEQ ID NO: 175890 - RNA, 1410 nt, Artificial Sequence
  derived and/or modified sequence opt4 from neuraminidase__InfluenzaA__AGG13702
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcaacgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175891 - RNA, 1410 nt, Artificial Sequence; identical to SEQ ID NO: 175874
  derived and/or modified sequence opt4 from neuraminidase__InfluenzaA__AGG13714

SEQ ID NO: 175892 - RNA, 1410 nt, Artificial Sequence; identical to SEQ ID NO: 174666
  derived and/or modified sequence opt4 from neuraminidase__InfluenzaA__AGG13726

SEQ ID NO: 175893 - RNA, 1410 nt, Artificial Sequence; identical to SEQ ID NO: 174666
  derived and/or modified sequence opt4 from neuraminidase__InfluenzaA__AGG13738

SEQ ID NO: 175894 - RNA, 1410 nt, Artificial Sequence; identical to SEQ ID NO: 174666
  derived and/or modified sequence opt4 from neuraminidase__InfluenzaA__AGG13750

SEQ ID NO: 175895 - RNA, 1410 nt, Artificial Sequence
  derived and/or modified sequence opt4 from neuraminidase__InfluenzaA__AGG13762
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175896 - RNA, 1410 nt, Artificial Sequence
  derived and/or modified sequence opt4 from neuraminidase__InfluenzaA__AGG13774
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaccaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175897 - RNA, 1410 nt, Artificial Sequence
  derived and/or modified sequence opt4 from neuraminidase__InfluenzaA__AGG13786
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaaccugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175898 - RNA, 1410 nt, Artificial Sequence; identical to SEQ ID NO: 175874
  derived and/or modified sequence opt4 from neuraminidase__InfluenzaA__AGG13798

SEQ ID NO: 175899 - RNA, 1410 nt, Artificial Sequence
  derived and/or modified sequence opt4 from neuraminidase__InfluenzaA__AGG13810
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccugggccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175900 - RNA, 1410 nt, Artificial Sequence; identical to SEQ ID NO: 175874
  derived and/or modified sequence opt4 from neuraminidase__InfluenzaA__AGG13822

SEQ ID NO: 175901 - RNA, 1410 nt, Artificial Sequence; identical to SEQ ID NO: 175874
  derived and/or modified sequence opt4 from neuraminidase__InfluenzaA__AGG13834

SEQ ID NO: 175902 - RNA, 1410 nt, Artificial Sequence; identical to SEQ ID NO: 175895
  derived and/or modified sequence opt4 from neuraminidase__InfluenzaA__AGG13846

SEQ ID NO: 175903 - RNA, 1410 nt, Artificial Sequence; identical to SEQ ID NO: 174666
  derived and/or modified sequence opt4 from neuraminidase__InfluenzaA__AGG13858

SEQ ID NO: 175904 - RNA, 1410 nt, Artificial Sequence
  derived and/or modified sequence opt4 from neuraminidase__InfluenzaA__AGG13870
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacagaugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaccagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175905 - RNA, 1410 nt, Artificial Sequence
  derived and/or modified sequence opt4 from neuraminidase__InfluenzaA__AGG13894
augaaccccaaccagaagaucaucaccaucggcagcgugagccugaccaucagcaccgugugcuucuucaugcagaucgccauccugaucaccaccgugacccugcacuucaagcaguacgaguucaacagcccccccaacaaccaggugaugcugugcgagcccaccaucaucgagagaaacgugaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175906 - RNA, 1410 nt, Artificial Sequence; identical to SEQ ID NO: 175874
  derived and/or modified sequence opt4 from neuraminidase__InfluenzaA__AGG13906

SEQ ID NO: 175907 - RNA, 1410 nt, Artificial Sequence
  derived and/or modified sequence opt4 from neuraminidase__InfluenzaA__AGG13930
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagaagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175908 - RNA, 1410 nt, Artificial Sequence; identical to SEQ ID NO: 175884
  derived and/or modified sequence opt4 from neuraminidase__InfluenzaA__AGG13942

SEQ ID NO: 175909 - RNA, 1410 nt, Artificial Sequence
  derived and/or modified sequence opt4 from neuraminidase__InfluenzaA__AGG13965
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175910 - RNA, 1410 nt, Artificial Sequence; identical to SEQ ID NO: 175877
  derived and/or modified sequence opt4 from neuraminidase__InfluenzaA__AGG13976

SEQ ID NO: 175911 - RNA, 1410 nt, Artificial Sequence; identical to SEQ ID NO: 175877
  derived and/or modified sequence opt4 from neuraminidase__InfluenzaA__AGG13988

SEQ ID NO: 175912 - RNA, 1410 nt, Artificial Sequence; identical to SEQ ID NO: 175877
  derived and/or modified sequence opt4 from neuraminidase__InfluenzaA__AGG14000

SEQ ID NO: 175913 - RNA, 1410 nt, Artificial Sequence; identical to SEQ ID NO: 175877
  derived and/or modified sequence opt4 from neuraminidase__InfluenzaA__AGG14012

SEQ ID NO: 175914 - RNA, 1410 nt, Artificial Sequence; identical to SEQ ID NO: 175895
  derived and/or modified sequence opt4 from neuraminidase__InfluenzaA__AGG14024

SEQ ID NO: 175915 - RNA, 1410 nt, Artificial Sequence
  derived and/or modified sequence opt4 from neuraminidase__InfluenzaA__AGG14036
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacaugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 175916 - RNA, 1410 nt, Artificial Sequence; identical to SEQ ID NO: 175895
  derived and/or modified sequence opt4 from neuraminidase__InfluenzaA__AGG14321

SEQ ID NO: 175917 - RNA, 1410 nt, Artificial Sequence; identical to SEQ ID NO: 174666
  derived and/or modified sequence opt4 from neuraminidase__InfluenzaA__AGG14333

SEQ ID NO: 175918 - RNA, 1410 nt, Artificial Sequence; identical to SEQ ID NO: 174307
  derived and/or modified sequence opt4 from neuraminidase__InfluenzaA__AGG84182

SEQ ID NO: 175919 - RNA, 1398 nt, Artificial Sequence
  derived and/or modified sequence opt4 from neuraminidase__InfluenzaA__AGJ51955
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugcuguggaccggcgacagcaucgugagcaugugcagcagcaccgaguuccugggccaguggaacuggcccgacggcgccaagaucgaguacuuccuguga

SEQ ID NO: 175920 - RNA, 1398 nt, Artificial Sequence
  derived and/or modified sequence opt4 from neuraminidase__InfluenzaA__AGJ72863
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggaggugaucagaggcagacccaaggaggacaagguguggugggccggcaacagcaucgugagcaugugcagcagcaccgaguuccugggccaguggaacuggcccgacggcgccaagaucgaguacuuccuguga

SEQ ID NO: 175921 - RNA, 1410 nt, Artificial Sequence
  derived and/or modified sequence opt4 from neuraminidase__InfluenzaA__AGJ73328
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaacggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175922 - RNA, 1410 nt, Artificial Sequence; identical to SEQ ID NO: 172777
  derived and/or modified sequence opt4 from neuraminidase__InfluenzaA__AGJ73330

SEQ ID NO: 175923 - RNA, 1410 nt, Artificial Sequence
  derived and/or modified sequence opt4 from neuraminidase__InfluenzaA__AGJ73332
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccacaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175924 - RNA, 1410 nt, Artificial Sequence; identical to SEQ ID NO: 172777
  derived and/or modified sequence opt4 from neuraminidase__InfluenzaA__AGJ73334

SEQ ID NO: 175925 - RNA, 1410 nt, Artificial Sequence; identical to SEQ ID NO: 172777
  derived and/or modified sequence opt4 from neuraminidase__InfluenzaA__AGJ73336

SEQ ID NO: 175926 - RNA, 1410 nt, Artificial Sequence; identical to SEQ ID NO: 172777
  derived and/or modified sequence opt4 from neuraminidase__InfluenzaA__AGJ73338

SEQ ID NO: 175927 - RNA, 1410 nt, Artificial Sequence
  derived and/or modified sequence opt4 from neuraminidase__InfluenzaA__AGJ73340
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgccagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175928 - RNA, 1410 nt, Artificial Sequence
  derived and/or modified sequence opt4 from neuraminidase__InfluenzaA__AGJ73342
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 175929 - RNA, 1410 nt, Artificial Sequence; identical to SEQ ID NO: 173229
  derived and/or modified sequence opt4 from neuraminidase__InfluenzaA__AGJ73344

SEQ ID NO: 175930 - RNA, 1410 nt, Artificial Sequence
  derived and/or modified sequence opt4 from neuraminidase__InfluenzaA__AGJ73346
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaagugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 175931 - RNA, 1410 nt, Artificial Sequence
  derived and/or modified sequence opt4 from neuraminidase__InfluenzaA__AGJ73348
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcgugaucagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175932 - RNA, 1410 nt, Artificial Sequence
  derived and/or modified sequence opt4 from neuraminidase__InfluenzaA__AGJ73350
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacgagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggugaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175933 - RNA, 1410 nt, Artificial Sequence
  derived and/or modified sequence opt4 from neuraminidase__InfluenzaA__AGJ73352
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacagccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175934 - RNA, 1410 nt, Artificial Sequence; identical to SEQ ID NO: 173229
  derived and/or modified sequence opt4 from neuraminidase__InfluenzaA__AGJ73354

SEQ ID NO: 175935 - RNA, 1410 nt, Artificial Sequence
  derived and/or modified sequence opt4 from neuraminidase__InfluenzaA__AGJ73356
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacuucaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175936 - RNA, 1410 nt, Artificial Sequence; identical to SEQ ID NO: 173229
  derived and/or modified sequence opt4 from neuraminidase__InfluenzaA__AGJ73358

SEQ ID NO: 175937 - RNA, 1410 nt, Artificial Sequence; identical to SEQ ID NO: 173229
  derived and/or modified sequence opt4 from neuraminidase__InfluenzaA__AGJ73360

SEQ ID NO: 175938 - RNA, 1410 nt, Artificial Sequence
  derived and/or modified sequence opt4 from neuraminidase__InfluenzaA__AGJ73362
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgacggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175939 - RNA, 1410 nt, Artificial Sequence; identical to SEQ ID NO: 174352
  derived and/or modified sequence opt4 from neuraminidase__InfluenzaA__AGJ73364

SEQ ID NO: 175940 - RNA, 1410 nt, Artificial Sequence; identical to SEQ ID NO: 173229
  derived and/or modified sequence opt4 from neuraminidase__InfluenzaA__AGJ73366

SEQ ID NO: 175941 - RNA, 1410 nt, Artificial Sequence; identical to SEQ ID NO: 172777
  derived and/or modified sequence opt4 from neuraminidase__InfluenzaA__AGJ73370

SEQ ID NO: 175942 - RNA, 1410 nt, Artificial Sequence
  derived and/or modified sequence opt4 from neuraminidase__InfluenzaA__AGJ73372
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccacaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175943 - RNA, 1410 nt, Artificial Sequence; identical to SEQ ID NO: 172777
  derived and/or modified sequence opt4 from neuraminidase__InfluenzaA__AGJ73374

SEQ ID NO: 175944 - RNA, 1410 nt, Artificial Sequence
  derived and/or modified sequence opt4 from neuraminidase__InfluenzaA__AGJ73376
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagauccugagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaccaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175945 - RNA, 1410 nt, Artificial Sequence
  derived and/or modified sequence opt4 from neuraminidase__InfluenzaA__AGJ73379
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175946 - RNA, 1410 nt, Artificial Sequence
  derived and/or modified sequence opt4 from neuraminidase__InfluenzaA__AGJ73381
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacgagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175947 - RNA, 1410 nt, Artificial Sequence
  derived and/or modified sequence opt4 from neuraminidase__InfluenzaA__AGK62992
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggaggugaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175948 - RNA, 1410 nt, Artificial Sequence
  derived and/or modified sequence opt4 from neuraminidase__InfluenzaA__AGK62996
augaaccccaaccagaagaucaucaccaucggcagcgugagccugaucaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagagcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175949 - RNA, 1410 nt, Artificial Sequence
  derived and/or modified sequence opt4 from neuraminidase__InfluenzaA__AGK62998
augaaccccaaccagaagaucaucaccaucggcagcgugagccugaccaucgccaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccugcugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagagcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175950 - RNA, 1410 nt, Artificial Sequence
  derived and/or modified sequence opt4 from neuraminidase__InfluenzaA__AGK63000
augaaccccaaccagaagaucaucaccaucggcagcgugagccugaccaucgccaccaucugcuucuucaugcagaucgccauccugaucaccaccgugacccugcacuucaagcagugcgacuucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175951 - RNA, 1410 nt, Artificial Sequence
  derived and/or modified sequence opt4 from neuraminidase__InfluenzaA__AGK63002
augaaccccaaccagaagaucaucaccaucggcagcgugagccugaccaucagcaccaucugcuucuucaugcagaucgccauccugaugaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcaacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaccgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175952 - RNA, 1410 nt, Artificial Sequence
  derived and/or modified sequence opt4 from neuraminidase__InfluenzaA__AGK63004
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcagccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175953 - RNA, 1410 nt, Artificial Sequence
  derived and/or modified sequence opt4 from neuraminidase__InfluenzaA__AGK63006
augaaccccaaccagaagaucaucaccaucggcagcgugagccugaccaucgccaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcgccaaggccgacaccaagauccuguucaucgaggagggcaagaucgugcacaccagcacccugagcggcagcgcccagcacguggaggagugcagcugcuaccccagauacagcggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagccagcugcagaucaacagacaggugaucguggacagaggcgacagaagcggcuacagcggcaucuucagcguggagagcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175954 - RNA, 1410 nt, Artificial Sequence
  derived and/or modified sequence opt4 from neuraminidase__InfluenzaA__AGK63008
augaaccccaaccagaagaucaucaccaucggcagcgugagccugaccaucgccaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaugaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175955 - RNA, 1410 nt, Artificial Sequence
  derived and/or modified sequence opt4 from neuraminidase__InfluenzaA__AGK63010
augaaccccaaccagaagaucaucaccaucggcagcgugagccugaccaucgccaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcgaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175956 - RNA, 1410 nt, Artificial Sequence
  derived and/or modified sequence opt4 from neuraminidase__InfluenzaA__AGK63012
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcuacagaagcggcuacagcggcaucuucagcguggagggcaagagcugcaucaacagaugcuucuacguggaccugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175957 - RNA, 1410 nt, Artificial Sequence
  derived and/or modified sequence opt4 from neuraminidase__InfluenzaA__AGK63014
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuucccccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccacagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175958 - RNA, 1410 nt, Artificial Sequence
  derived and/or modified sequence opt4 from neuraminidase__InfluenzaA__AGK63018
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175959 - RNA, 1410 nt, Artificial Sequence
  derived and/or modified sequence opt4 from neuraminidase__InfluenzaA__AGK63020
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175960 - RNA, 1410 nt, Artificial Sequence
  derived and/or modified sequence opt4 from neuraminidase__InfluenzaA__AGK63022
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggaccugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175961 - RNA, 1410 nt, Artificial Sequence; identical to SEQ ID NO: 175959
  derived and/or modified sequence opt4 from neuraminidase__InfluenzaA__AGK63024

SEQ ID NO: 175962 - RNA, 1410 nt, Artificial Sequence; identical to SEQ ID NO: 175959
  derived and/or modified sequence opt4 from neuraminidase__InfluenzaA__AGK63026

SEQ ID NO: 175963 - RNA, 1410 nt, Artificial Sequence
  derived and/or modified sequence opt4 from neuraminidase__InfluenzaA__AGK63028
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaagaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagguggugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggaggccaagagcugcaucaucagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175964 - RNA, 1410 nt, Artificial Sequence; identical to SEQ ID NO: 175958
  derived and/or modified sequence opt4 from neuraminidase__InfluenzaA__AGK63030

SEQ ID NO: 175965 - RNA, 1410 nt, Artificial Sequence
  derived and/or modified sequence opt4 from neuraminidase__InfluenzaA__AGK63032
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaccgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175966 - RNA, 1410 nt, Artificial Sequence
  derived and/or modified sequence opt4 from neuraminidase__InfluenzaA__AGK63034
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggugcacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaagaaggagaccgaggugcuguggaccagcaacagcaucgugguguucugcggcaccagcggcaccuacggcaccggcagcuggcccgacggcgccgacaucaaccugaugcccaucuga

SEQ ID NO: 175967 - RNA, 1410 nt, Artificial Sequence
  derived and/or modified sequence opt4 from neuraminidase__InfluenzaA__AGK63036
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagauucggcuacgagaccaucaaggugaucgagggcuggagcaaccccaagagcaaccugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175968 - RNA, 1410 nt, Artificial Sequence
  derived and/or modified sequence opt4 from neuraminidase__InfluenzaA__AGK63038
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagagcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175969 - RNA, 1410 nt, Artificial Sequence
  derived and/or modified sequence opt4 from neuraminidase__InfluenzaA__AGK63040
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175970 - RNA, 1410 nt, Artificial Sequence
  derived and/or modified sequence opt4 from neuraminidase__InfluenzaA__AGK63042
augaaccccaaccagaagaucaucaccaucggcagcgugagccugaccaucagcaccaucugcuucuucaugcagaucgccauccugaucaccaccgugacccugcacuucaagcagugcgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175971 - RNA, 1410 nt, Artificial Sequence
  derived and/or modified sequence opt4 from neuraminidase__InfluenzaA__AGK63044
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcuacagaagcggcuacagcggcaucuucagcguggagagcaagagcugcaucaacagaugcuucuacguggagcugcugagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175972 - RNA, 1410 nt, Artificial Sequence
  derived and/or modified sequence opt4 from neuraminidase__InfluenzaA__AGK63046
augaaccccaaccagaagaucaucaccaucggcagcgugagccugaccaucagcaccaucugcuucuucaugcagaucgccauccugaucaccaccgugacccugcacuucaagcacuacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggaccugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 175973 - RNA, 1398 nt, Artificial Sequence
  derived and/or modified sequence opt4 from neuraminidase__InfluenzaA__AGK82159
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacgagaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 175974 - RNA, 1398 nt, Artificial Sequence
  derived and/or modified sequence opt4 from neuraminidase__InfluenzaA__AGK84858
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 175975 - RNA, 1398 nt, Artificial Sequence
  derived and/or modified sequence opt4 from neuraminidase__InfluenzaA__AGK84861
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccguggugcagaucgaccccguggccaugacccacaccagccaguacaucugcagccccgugcugaccgacaaccccagacccaacgaccccaacaucggcaagugcaacgaccccuaccccggcaucaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 175976 - RNA, 1398 nt, Artificial Sequence; identical to SEQ ID NO: 175974
  derived and/or modified sequence opt4 from neuraminidase__InfluenzaA__AGK84864

SEQ ID NO: 175977 - RNA, 1398 nt, Artificial Sequence
  derived and/or modified sequence opt4 from neuraminidase__InfluenzaA__AGL95090
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaacaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcaaggacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 175978 - RNA, 1413 nt, Artificial Sequence; identical to SEQ ID NO: 169152
  derived and/or modified sequence opt4 from neuraminidase__InfluenzaA__AGL96802

SEQ ID NO: 175979 - RNA, 1413 nt, Artificial Sequence; identical to SEQ ID NO: 169152
  derived and/or modified sequence opt4 from neuraminidase__InfluenzaA__AGL96807

SEQ ID NO: 175980 - RNA, 1413 nt, Artificial Sequence
  derived and/or modified sequence opt4 from neuraminidase__InfluenzaA__AGL96808
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcuucuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175981 - RNA, 1413 nt, Artificial Sequence
  derived and/or modified sequence opt4 from neuraminidase__InfluenzaA__AGL96809
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaagaccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175982 - RNA, 1413 nt, Artificial Sequence; identical to SEQ ID NO: 169152
  derived and/or modified sequence opt4 from neuraminidase__InfluenzaA__AGL96818

SEQ ID NO: 175983 - RNA, 1413 nt, Artificial Sequence
  derived and/or modified sequence opt4 from neuraminidase__InfluenzaA__AGL96820
augaaccccaaccagaagaucaucaccaccggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175984 - RNA, 1413 nt, Artificial Sequence
  derived and/or modified sequence opt4 from neuraminidase__InfluenzaA__AGL96821
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugagcguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 175985 - RNA, 1410 nt, Artificial Sequence
  derived and/or modified sequence opt4 from neuraminidase__InfluenzaA__AGN69269
augaucaccaaccagagaaucaucaccaucggcaccgugugccugaucgugggcaucgugagccugcugcugcagaucggcaacaucgugagccuguggaucagccacagcauccagaccggcgagaagaaccacagcgagaucugcaaccagaacaccaucaccuacgagaacaacaccugggugaaccagaccuacgugaacaucagcaacaccaacaucgccgacggccagggcgugaccagcaucauccuggccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggaucaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgcccugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcguggacagcgagaccgccagcuggagcuggcccgacggcgccgaccugcccuucaccaucgacaaguga

SEQ ID NO: 175986 - RNA, 1410 nt, Artificial Sequence
  derived and/or modified sequence opt4 from neuraminidase__InfluenzaA__AGN69280
augaacaccaaccagagaaucaucaccaucggcaccgugugccugaucgugggcaucgugagccugcugcugcagaucggcaacaucgugagccuguggaucagccacagcauccagaccggcgagaagaaccacagcgagaucugcaaccagaacaccaucaccuacgagaacaacaccugggugaaccagaccuacgugaacaucagcaacaccaacaucgccgacggccagggcgugaccagcaucauccuggccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccggcggcagcagcaucagcuucugcggcguggacagcgagaccgccagcuggagcuggcccgacggcgccgaccugcccuucaccaucgacaaguga

SEQ ID NO: 175987 - RNA, 1410 nt, Artificial Sequence
  derived and/or modified sequence opt4 from neuraminidase__InfluenzaA__AGN69292
augaaccccaaccagaagaucaucaccaucggcagcaucugcaugaccaucggcaucgccagccugauccugcagaucggcaacaucaucagcaucuggaucagccacagcauccagaccgagaaccagaaccagcccgagaucugcaaccagaacgugaucaccuacgagaacaacaccugggugaaccagaccuacgugaacaucagcaacaccaacuucguggccgagcaggccguggccagcgugaagcuggccggcaacagcagccugugccccgugagcggcugggccaucuacagcaaggacaacagcgugagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaagaacauccugagaacccaggagagcgagugcgccugcgugaacggcagcugcuucaccgugaugaccgacggccccagcaacggccaggccagcuacaagguguucaagaucgagaagggcaagguggugaagagcguggagcugaacgcccccaacuaccacuacgaggagugcagcugcuaccccgagagcggcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccguguucagcaacggcgccaacggcgugaagggcuucagcuucaaguacggcaacggcguguggaucggcagaaccaagagcaucagcagcagaaugggcuucgagaugaucugggaccccgacggcuggaccaagaccgacgacaaguucagcgugaagcaggacaucaucggcaucaacgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175988 - RNA, 1410 nt, Artificial Sequence
  derived and/or modified sequence opt4 from neuraminidase__InfluenzaA__AGN69316
augaaccccaaccagaagaucaucaccaucggcagcaucugcaugaccaucggcaucgccagccugauccugcagaucggcaacaucaucagcaucuggaucagccacagcauccagaccgagaaccagaaccagcccgagaucugcaaccagaacgugaucaccuacgagaacaacaccugggugaaccagaccuacgugaacaucagcaacaccaacuucguggccgagcaggccguggccagcgugaagcuggccggcaacagcagccugugccccgugagcggcugggccaucuacagcaaggacaacagcgugagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaagaacauccugagaacccaggagagcgagugcgccugcgugaacggcagcugcuucaccgugaugaccgacggccccagcaacggccaggccagcuacaagguguucaagaucgagaagggcaagguggugaagaccguggagcugaacgcccccaacuaccacuacgaggagugcagcugcuaccccgagagcggcgagaucaccugcgugugcagagacaacuggcacggcagcaacagacccugggugagcuucaaccagaaccuggaguaccagaugggcuacaucugcagcggcaucuucggcgacaaccccagacccaacgacaagaccggcagcugcggccccguguucagcaacggcgccaacggcgugaagggcuucagcuucaaguacggcaacggcguguggaucggcagaaccaagagcaucagcagcagaaugggcuucgagaugaucugggaccccgacggcuggaccaagaccgacgacaaguucagcgugaagcaggacaucaucggcaucaacgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175989 - RNA, 1410 nt, Artificial Sequence; identical to SEQ ID NO: 175988
  derived and/or modified sequence opt4 from neuraminidase__InfluenzaA__AGN69328

SEQ ID NO: 175990 - RNA, 1410 nt, Artificial Sequence
  derived and/or modified sequence opt4 from neuraminidase__InfluenzaA__AGN69340
augaaccccaaccagaagaucaucaccaucggccugaucugcaugaccaucggcaucgccagccugauccugcagaucggcaacaucaucagcaucuggaucagccacagcauccagaccgagaaccagaacaagcccgagaucugcaaccagaacgugaucaccuacgagaacaacaccugggugaaccagaccuacgugaacgugagcaacaccaacuucguggccgagcaggccguggccagcgugaagcuggugggcaacagcagccugugccccgugagcggcugggccaucuacagcaaggacaacagcgugagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaagaacauccugagaacccaggagagcgagugcgccugcgugaacggcagcugcuucaccgugaugaccgacggccccagcaacggccaggccagcuacaagguguucaagaucgagagaggcaagguggugaagagcguggagcugaacgcccccaacuaccacuacgaggagugcagcugcuaccccgagagcagcgagaucaccugcgugugcagagacaacuggcacggcagcaacagacccugggugagcuucaaccagaaccuggaguaccagaugggcuacaucugcagcggcguguucggcgacaaccccagacccaacgacaagaccggcagcugcggccccguguucagcaacggcgccaacggcgugaagggcuucagcuucaaguacggcaacggcguguggaucggcagaaccaagagcaccagcagcagaaugggcuucgagaugaucugggaccccgacggcuggaccaagaccgacgacaaguucagcgugaagcaggacaucaucggcaucaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 175991 - RNA, 1410 nt, Artificial Sequence
  derived and/or modified sequence opt4 from neuraminidase__InfluenzaA__AGO00268
augaaccccaaccagaagaucaucaccaucggcagcaucugcaugguggugggcaucaucagccugauccugcagaucggcaacaucaucagcaucuggaucagccacagcauccagaccggcagccagaaccacaccggcaucugcaaccagagcaucaucaccuacaagaacagcaccugggugaaccagaccuacgugaacaucagcaacaccaacgugguggccggcaaggacaccaccagcaugauccuggccggcaacagcagccugugccccaucagaggcugggccaucuacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggaagaagaagauccugagaacccaggagagcgagugcgugugcgugaacggcagcugcuucaccaucaugaccgacggccccagcgacggccccgccagcuacaagaucuucaagaucgagaagggcaaggugaccaagagcaucgagcuggacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaagggcagcugcggccccguguacguggacggcgccaacggcgugaagggcuucagcuacagauacggcgacggcguguggaucggcagaaccaagagcaacagcagcagacagggcuucgagaugaucugggaccccaacggcuggaccgagaccgacagcagcuucuucgugaagcaggacgugguggccaugaccgacuggagcggcuacagcggcagcuucgugcagcaccccgagcugaccggccugaacugcaugagacccugcuucuggguggagcugaucagaggcagacccaaggagaagaccaucuggaccagcggcagcagcaucagcuucugcggcgugaacagcgacaccguggacuggagcuggcccgacggcgccgagcugcccuucaccaucgacaaguga

SEQ ID NO: 175992 - RNA, 1410 nt, Artificial Sequence
  derived and/or modified sequence opt4 from neuraminidase__InfluenzaA__AGO00280
augaaccccaaccagaagaucaucaccaucggcagcaucugcaugguggugggcaucaucagccugauccugcagaucggcaacaucgugagcaucuggaucagccacagcauccagaccggcaaccagaaccacaccggcaccugcaaccagagcaucaucaccuacaagaacagcaccugggugaaccagaccuacgugaacaucagcaacaccaacgugguggccggcaaggacaccaccagcgugauccuggccggcaacagcagccugugccccaucagaggcugggccaucuacagcaaggacaacggcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaaggagauccugagaacccaggagagcgagugcgugugcgugaacggcagcugcuucaccaucaugaccgacggccccagcggcggccccgccagcuacaagaucuucaagaucgagaagggcaaggugaccaagagcaucgagcuggacgcccccaacagccacuacgaggagugcagcugcuaccccgacaccagcaaggugaugugcgugugcagagacaacuggcacggcagcaacagacccugggugagcuucgaccagaaccuggacuaccagaugggcuacaucugcagcggcguguucggcgacaaccccagacccaaggacggcaagggcagcugcggccccguguacguggacggcgccaacggcgugaagggcuucagcuacagauacggcaacggcguguggaucggcagaaccaagagcaacagcagcagacagggcuucgagaugaucugggaccccaacggcuggaccgagaccgacagcaacuucuucaugaagcaggacgugguggccgugaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 175993 - RNA, 1413 nt, Artificial Sequence
  derived and/or modified sequence opt4 from neuraminidase__InfluenzaA__AGO00292
augaaccccaaccagaagaucaucaccaucggcagcaucugcaugaccaucggcaccaucagccugauccugcagaucggcaacaucaucagcaucuggaucagccacagcauccagaccggcagccagaaccacaccggcaucugcaaccagagaaucaucaccuacgagaacaacaccugggugaaccagaccuacgugaacaucagcaacaccaacgugguggccggcaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaucaucaagagcuggagaaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcgacggcguguggaucggcagaaccaagagcaacagcagcagaaagggcuucgagaugaucugggaccccaacggcuggaccgacaccgacgacaacuuccuggugaagcaggacgugguggccaugaccgacuggagcggcuacagcggcagcuucgugcagcaccccgagcugaccggccuggacugcaucagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacauguga

SEQ ID NO: 175994 - RNA, 1413 nt, Artificial Sequence
  derived and/or modified sequence opt4 from neuraminidase__InfluenzaA__AGO00304
augaaccccaaccagaagaucaucaccaucggcagcaucugcauggccaucggcaccaucagccugauccugcagaucggcaacaucaucagcaucuggaucagccacagcauccagaccggcagccagaaccacaccggcaucugcaaccagagaaucaucaccuacgagaacaacaccugggugaaccagaccuacgugaacaucagcaacaccaacgugguggccggcaaggacaccaccagcaugauccuggccggcaacaccagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaucaucaagagcuggagaaagcagauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccaacaccgacggcaacuucagcgugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 175995 - RNA, 1410 nt, Artificial Sequence; identical to SEQ ID NO: 175064
  derived and/or modified sequence opt4 from neuraminidase__InfluenzaA__AGO00316

SEQ ID NO: 175996 - RNA, 1410 nt, Artificial Sequence; identical to SEQ ID NO: 174508
  derived and/or modified sequence opt4 from neuraminidase__InfluenzaA__AGO00328

SEQ ID NO: 175997 - RNA, 1410 nt, Artificial Sequence; identical to SEQ ID NO: 166615
  derived and/or modified sequence opt4 from neuraminidase__InfluenzaA__AGO00340

SEQ ID NO: 175998 - RNA, 1365 nt, Artificial Sequence; identical to SEQ ID NO: 168239
  derived and/or modified sequence opt4 from neuraminidase__InfluenzaA__AGO00352

SEQ ID NO: 175999 - RNA, 1365 nt, Artificial Sequence; identical to SEQ ID NO: 168239
  derived and/or modified sequence opt4 from neuraminidase__InfluenzaA__AGO00376

SEQ ID NO: 176000 - RNA, 1365 nt, Artificial Sequence; identical to SEQ ID NO: 168239
  derived and/or modified sequence opt4 from neuraminidase__InfluenzaA__AGO00388

SEQ ID NO: 176001 - RNA, 1365 nt, Artificial Sequence; identical to SEQ ID NO: 168239
  derived and/or modified sequence opt4 from neuraminidase__InfluenzaA__AGO00400

SEQ ID NO: 176002 - RNA, 1365 nt, Artificial Sequence; identical to SEQ ID NO: 168239
  derived and/or modified sequence opt4 from neuraminidase__InfluenzaA__AGO00412

SEQ ID NO: 176003 - RNA, 1365 nt, Artificial Sequence; identical to SEQ ID NO: 168239
  derived and/or modified sequence opt4 from neuraminidase__InfluenzaA__AGO00424

SEQ ID NO: 176004 - RNA, 1365 nt, Artificial Sequence
  derived and/or modified sequence opt4 from neuraminidase__InfluenzaA__AGO00436
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcagcggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagcaacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucagcaucgacaaguga

SEQ ID NO: 176005 - RNA, 1365 nt, Artificial Sequence
  derived and/or modified sequence opt4 from neuraminidase__InfluenzaA__AGO00448
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcagcggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacagaaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucagcaucgacaaguga

SEQ ID NO: 176006 - RNA, 1410 nt, Artificial Sequence
  derived and/or modified sequence opt4 from neuraminidase__InfluenzaA__AGQ47722
augaacaccaaccagagaaucaucaccaucggcaccaucugccugaucgugggcaucaucagccugcugcugcagaucggcaacaucaucagccuguggaucagccacagcauccagaccggcgagaagagccaccccgagaucugcaaccagagcgugaucaccuacgagaacaacaccugggugaaccagaccuacgugaacaucagcaacaccaacaucgccgccggccagggcgugacccccaucauccuggccggcaacagcagccugugccccaucagcggcugggccaucuacagcaaggacaacagcaucagaaucggcagcaagggcgacaucuucgugaugagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcaucgagcuggacgcccccaacuaccacuacgaggagugcagcugcuaccccgacaccggcaaggugaugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagauggugugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcgugaacagcggcaccgccagcuggagcuggcccgacggcgccgaccugcccuucaccaucgacaaguga

SEQ ID NO: 176007 - RNA, 1413 nt, Artificial Sequence; identical to SEQ ID NO: 168973
  derived and/or modified sequence opt4 from neuraminidase__InfluenzaA__AGQ47731

SEQ ID NO: 176008 - RNA, 1377 nt, Artificial Sequence
  derived and/or modified sequence opt4 from neuraminidase__InfluenzaA__AGQ47743
augaaccccaaccagaagaucaucaccaucggcagcaucugcaugguggugggcaucaucagccugauccugcagaucggcaacaucaucagcaucuggaucagccacagcauccagaccggcaaccagaaccacaagaacagcaccuggaugaaccagaccuacaucaacaucagcaacaccaacgugguggccggccaggacagcaccagcgugauccugaccggcaacagcagccugugccccaucagaggcugggccaucaacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcaccugcgugaacggcagcugcuucaccaucaugaccgacggccccagcaacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccgugagcgccgacggcgccaacggcgugaagggcuucagcuacagauacggcaacggcguguggaucggcagaaccaagagcaacagcagcagacacggcuucgagaugaucugggaccccaacggcuggaccgagaccgacagcagauucagcgugagacaggacgugguggccaugaccgacagaagcggcuacagcggcagcuucgugcagcaccccgagcugaccggccuggacugcaugagacccugcuucuggguggagcugaucagaggcagacccgaggaggagaccaucuggaccagcggcagcaucaucagcuucugcggcgugaacagcgacaccguggacuggagcuggcccgacggcgccgagcugcccuucaccaucgacaaguga

SEQ ID NO: 176009 - RNA, 1413 nt, Artificial Sequence
  derived and/or modified sequence opt4 from neuraminidase__InfluenzaA__AGQ47755
augaaccccaaccagaagaucaucaccaucggcagcaucugcauggccaucggcaccaucagccugauccugcagaucggcaacaucaucagcaucuggaucagccacagcauccagaccggcagccagaaccacaccggcaucugcaacagaagaaucgugaccuacgagaacaacaccugggugaaccagaccuacgugaacaucagcaacaccaacgugguggccgagaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaucaucaagagcuggagaaagcagauccugagaacccaggagagcgagugcgugugcgugaacggcagcugcuucaccaucaugaccgacggccccagcaacggccccgccagcuacagaaucuucaagaucaagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaccagcagcagaaagggcuucgagaugaucugggaccccaacggcuggaccgacaccgacggcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 176010 - RNA, 1410 nt, Artificial Sequence
  derived and/or modified sequence opt4 from neuraminidase__InfluenzaA__AGQ47767
augaaccccaaccagaagaucaucaccaucggcagcaucugcaugguggugggcaucaucagccugauccugcagaucggcaacaucgugagcaucuggaucagccacagcauccagaccggcaaccagaaccacaccggcaccugcgaccagagcaucaucaccuacaagaacagcaccugggugaaccagaccuacgugaacaucagcaacaccaacgugguggccggcaaggacaccaccagcgugauccuggccggcaacagcagccugugccccaucagaggcugggccaucuacagcaaggacaacggcgugagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaaggagauccugagaacccaggagagcgagugcgugugcgugaacggcagcugcuucaccaucaugaccgacggccccagcggcggccccgccagcuacaagaucuucaagaucgagaagggcaaggugaccaagagcaucgagcuggacgcccccaacagccacuacgaggagugcagcugcuaccccgacaccagcaaggugaugugcgugugcagagacaacuggcacggcagcaacagacccugggugagcuucgaccagaaccuggacuaccagaugggcuacaucugcagcggcguguucggcgacaaccccagacccaaggacggcaagggcagcugcggccccguguacguggacggcgccaacggcgugaagggcuucagcuacaaguacggcaacggcguguggaucggcagaaccaagagcaacagcagcagacagggcuucgagaugaucugggaccccaacggcuggaccgagaccgacagcaacuucuucaccaagcaggacgugguggccgugaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcgugaacagcgacaccguggacuggagcuggcccgacggcgccgagcugcccuucaccaucgacaaguga

SEQ ID NO: 176011 - RNA, 1410 nt, Artificial Sequence; identical to SEQ ID NO: 175992
  derived and/or modified sequence opt4 from neuraminidase__InfluenzaA__AGQ47779

SEQ ID NO: 176012 - RNA, 1413 nt, Artificial Sequence
  derived and/or modified sequence opt4 from neuraminidase__InfluenzaA__AGQ47791
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacaacaccugggugaaccagacccacgugaacaucagcaacaccaacgugguggccggcaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacggcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 176013 - RNA, 1410 nt, Artificial Sequence
  derived and/or modified sequence opt4 from neuraminidase__InfluenzaA__AGQ47803
augaaccccaaccagaagaucaucaccaucggcagcaucugcaugguggugggcaucaucagccugauccugcagaucggcaacaucaucagcaucuggaucagccacagcauccagaccggcagccagaaccacaccggcaucugcaaccagagcaucaucaccuacaagaacagcaccugggugaaccagaccuacgugaacaucagcaacaccaacgugguggccggcaagggcaccaccagcgugauccuggccggcaacagcagccugugccccaucagaggcugggccaucuacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccugcgccugccacgacggcaugggcuggcugaccaucggcaucagcggccccgacgacgaggccguggccgugcugaaguacaacggcaucaucaccgagaccaucaagagcuggagaaagaagauccugagaacccaggagagcgagugcgugugcgugaacggcagcugcuucaccaucaugaccgacggccccagcgacggccccgccagcuacaagaucuucaagaucgagaagggcaaggugaccaagagcaucgagcuggacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaagggcagcugcggccccguguacguggacggcgccaacggcgugaagggcuucagcuacagauacggcaacggcguguggaucggcagaaccaagagcgacagcagcagacagggcuucgagaugaucugggaccccaacggcuggaccgagaccgacagcaacuucuucgugaagcaggacaucguggccaugaccgacuggagcggcuacagcggcagcuucgugcagcaccccgagcugaccggccuggacugcaugagacccugcuucuggguggagcugaucagaggcagacccaaggagaagaccaucuggaccagcggcagcagcaucagcuucugcggcgugaacagcgacaccguggacuggagcuggcccgacggcgccgagcugcccuucaccaucgacaaguga

SEQ ID NO: 176014 - RNA, 1368 nt, Artificial Sequence
  derived and/or modified sequence opt4 from neuraminidase__InfluenzaA__AGQ47814
augaaccccaaccagaagaucaucaccaucggcagcaucugcauggccaucggcaucaucagccugauccugcagaucggcaacaucaucagcaucugggugagccacagcauccagaccggcagccagaaccacaccggcaucugcaaccagagaaucaucaccuacgagaacaacaccugggugaaggacaccaccagcaugacccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcgacggccccgccagcuacagaaucuucaagaucgagaagggcaagaucaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacggcaacuuccuggugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 176015 - RNA, 1413 nt, Artificial Sequence; identical to SEQ ID NO: 168977
  derived and/or modified sequence opt4 from neuraminidase__InfluenzaA__AGQ47826

SEQ ID NO: 176016 - RNA, 1410 nt, Artificial Sequence
  derived and/or modified sequence opt4 from neuraminidase__InfluenzaA__AGQ47838
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcuggugggcuacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccaagcaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcagcagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 176017 - RNA, 1362 nt, Artificial Sequence
  derived and/or modified sequence opt4 from neuraminidase__InfluenzaA__AGQ47850
augaaccccaaccagaagaucaucaccaucggcagcaucugcaugguggugggcaucaucagccugauccugcagaucggcaacaucaucagcaucuggaucagccacagcauccaggccggcagcagcaccugggugaaccagaccuacgugaacaucagcaacaccaacgugguggccggccccgacgccaccagcgugauccugaccggcaacagcagccugugccccaucagaggcugggccaucuacagcaaggacaacggcaucagaaucggcagcaagggcgacaucuucgugaucagagagcccuucaucagcugcagccaccuggagugcagagccuucuuccugacccagggcgcccugcugaacgacaagcacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccccgccagcuacaagaucuucaagaucgagaagggcaaggugaccaagagcaucgagcuggacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacagccccagacccaaggacggcaccggcagcugcggccccgugagcguggacggcgccaacggcgugaagggcuucagcuacagauacggcaacggcguguggaucggcagaaccaagagcaagagcagcagacacggcuucgagaugaucugggaccccaacggcuggaccgagaccgacagcagauucagcgugagacaggacgugguggccaugaccgacuggagcggcuacagcggcagcuucgugcagcaccccgagcugaccggccuggacugcaugagacccugcuucuggguggagcugaucagaggccagcccaaggagaagaccaucuggaccagcggcagcagcaucagcuucugcggcgugaacagcgacaccguggacuggagcuggcccgacggcgccgagcugcccuucaccaucgacaaguga

SEQ ID NO: 176018 - RNA, 1410 nt, Artificial Sequence
  derived and/or modified sequence opt4 from neuraminidase__InfluenzaA__AGQ47873
augaacaccaaccagagaaccaucaccaucggcaccaucugccugaucgugggcaucaucagccugcugcugcagaucggcaacaucauccugcuguggaugagccacagcauccagaccggcgagaagagccaccccaaggugugcaaccagagcgugaucaccuacgagaacaacaccugggugaaccagaccuacgugaacaucagcaacaccaacaucgccgccggccagggcgugacccccaucauccuggccggcaacagcagccugugccccaucagcggcugggccaucuacagcaaggacaacagcaucagaaucggcagcaagggcgacaucuucgugaugagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagcuguucaagauggagaagggcaagaucaucaagagcaucgagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcgugaacagcggcaccgccagcuggagcuggcccgacggcgccgaccugcccuucaccaucgacaaguga

SEQ ID NO: 176019 - RNA, 1410 nt, Artificial Sequence; identical to SEQ ID NO: 169734
  derived and/or modified sequence opt4 from neuraminidase__InfluenzaA__AGQ47885

SEQ ID NO: 176020 - RNA, 1410 nt, Artificial Sequence; identical to SEQ ID NO: 174500
  derived and/or modified sequence opt4 from neuraminidase__InfluenzaA__AGQ47897

SEQ ID NO: 176021 - RNA, 1410 nt, Artificial Sequence; identical to SEQ ID NO: 166615
  derived and/or modified sequence opt4 from neuraminidase__InfluenzaA__AGQ47909

SEQ ID NO: 176022 - RNA, 1410 nt, Artificial Sequence
  derived and/or modified sequence opt4 from neuraminidase__InfluenzaA__AGQ47921
augaaccccaaccagaagaucaucaccaucggcagcgugagccugaccaucgccaccgugugcuuccugaugcagaccgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggaggccagagugugguggaccagcaacagcaucgugguguucugcggcaccagcggcaccuacggcaccggcagcuggcccgacggcgccaacaucaacuucaugcccaucuga

SEQ ID NO: 176023 - RNA, 1365 nt, Artificial Sequence
  derived and/or modified sequence opt4 from neuraminidase__InfluenzaA__AGQ47933
augaaccccaaccagaagaucaucaccaucggcagcaucugcaugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacagacacagcaacggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccaaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaucagacccugcuucuggguggagcugaucagaggcagacccaaggagaagaccaucuggaccagcgccagcagcaucagcuucugcggcgugaacagcgacaccgugaacuggagcuggcccgacggcgccgagcugcccuucaccaucgacaaguga

SEQ ID NO: 176024 - RNA, 1365 nt, Artificial Sequence; identical to SEQ ID NO: 168239
  derived and/or modified sequence opt4 from neuraminidase__InfluenzaA__AGQ47945

SEQ ID NO: 176025 - RNA, 1365 nt, Artificial Sequence; identical to SEQ ID NO: 168239
  derived and/or modified sequence opt4 from neuraminidase__InfluenzaA__AGQ47957

SEQ ID NO: 176026 - RNA, 1365 nt, Artificial Sequence; identical to SEQ ID NO: 168239
  derived and/or modified sequence opt4 from neuraminidase__InfluenzaA__AGQ47969

SEQ ID NO: 176027 - RNA, 1365 nt, Artificial Sequence; identical to SEQ ID NO: 168239
  derived and/or modified sequence opt4 from neuraminidase__InfluenzaA__AGQ47981

SEQ ID NO: 176028 - RNA, 1365 nt, Artificial Sequence
  derived and/or modified sequence opt4 from neuraminidase__InfluenzaA__AGQ48005
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccugggugaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcagcggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacagcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucagcaucgacaaguga

SEQ ID NO: 176029 - RNA, 1365 nt, Artificial Sequence; identical to SEQ ID NO: 176028
  derived and/or modified sequence opt4 from neuraminidase__InfluenzaA__AGQ48017

SEQ ID NO: 176030 - RNA, 1365 nt, Artificial Sequence; identical to SEQ ID NO: 168239
  derived and/or modified sequence opt4 from neuraminidase__InfluenzaA__AGQ48029

SEQ ID NO: 176031 - RNA, 1365 nt, Artificial Sequence
  derived and/or modified sequence opt4 from neuraminidase__InfluenzaA__AGQ48041
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccuggaucaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcagcggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccaugaccgacuggagcggcuacagcggcagcuucgugcagcaccccgagcugaccggccuggacugcaugagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucagcaucgacaaguga

SEQ ID NO: 176032 - RNA, 1365 nt, Artificial Sequence
  derived and/or modified sequence opt4 from neuraminidase__InfluenzaA__AGQ48053
augaaccccaaccagaagaucaucaccaucggcagcaucugccugguggugggccugaucagccugauccugcagaucggcaacaucaucagcaucuggaucagccacagcauccagaccggcagccagaaccacaccggcaucugcaaccagaacaucaucaccuacaagaacagcaccuggaucaaggacaccaccagcgugauccugaccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcagcggcaccgugaaggacagaagccccuacagagcccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggagaaagaagauccugagaacccaggagagcgagugcgccugcgugaacggcagcugcuucaccaucaugaccgacggccccagcgacggccuggccagcuacaagaucuucaagaucgagaagggcaaggugaccaagagcaucgagcugaacgcccccaacagccacuacgaggagugcagcugcuaccccgacaccggcaaggugaugugcgugugcagagacaacuggcacggcagcaacagacccugggugagcuucgaccagaaccuggacuaccagaucggcuacaucugcagcggcguguucggcgacaaccccagacccgaggacggcaccggcagcugcggccccguguacguggacggcgccaacggcgugaagggcuucagcuacagauacggcaacggcguguggaucggcagaaccaagagccacagcagcagacacggcuucgagaugaucugggaccccaacggcuggaccgagaccgacagcaaguucagcgugagacaggacgugguggccauggccgacuggagcggcuacagcggcagcuucgugcagcaccccgagcugaccggccuggacugcaugagacccugcuucuggguggagcugaucagaggcagacccaaggagaagaccaucuggaccagcgccagcagcaucagcuucugcggcgugaacagcgacaccguggacuggagcuggcccgacggcgccgagcugcccuucagcaucgacaaguga

SEQ ID NO: 176033 - RNA, 1410 nt, Artificial Sequence
  derived and/or modified sequence opt4 from neuraminidase__InfluenzaA__AGQ81707
augaaccccaaccagaagaucaucaccaucggcagcaucugcauggugaucggcaucgccagccugaugcugcagaucggcaacaugaucagcaucugggugagccacagcauccagaccggcaaccaguaccagcccgagcccugcaaccagagcaucaucaccuacgagaacaacaccugggugaaccagaccuacgugaacaucagcaacaccaacuuccugaccgagcaggccgugaccagcguggcccuggccggcaacagcagccugugccccaucagcggcugggccaucuacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaucgagaagggcaagguggugaagagcguggagcugaacgcccccaacuaccacuacgaggagugcagcugcuaccccgacgccggcaagaucaugugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccagcagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaugagacccugcuucuggguggagcugaucagaggcagacccaaggagaacaccaucuggaccagcggcagcagcaucagcuucugcggcguggacagcgacaccgugggcuggagcuggcccgacggcgccgagcugcccuucaccaucgacaaguga

SEQ ID NO: 176034 - RNA, 1410 nt, Artificial Sequence
  derived and/or modified sequence opt4 from neuraminidase__InfluenzaA__AGQ81715
augaaccccaaccagaagaucaucgccaucggcagcgugagccugaccaucgccaccaucugccugcugaugcagaucgccauccuggugaccaccaugacccugcacuucaagcacaacgagugcaccaacagcagcaacaaccaggccgugcccugcggccccaucaucaucgagagaaacgugaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaacccccuacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcggcaacagcagcggcuacagcggcaucuucagcaucgagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176035 - RNA, 1410 nt, Artificial Sequence
  derived and/or modified sequence opt4 from neuraminidase__InfluenzaA__AGQ81717
augaaccccaaccagaagaucaucgccaucggcagcgugagccugaccaucgccaccaucugccugcugaugcagaucgccauccuggugaccaccaugaccccccacuucaagcacgacgagugcaccaacagcagcaacaaccaggccgugcccugcggccccaucaucaucgagagaaacgugaccgagaucgugcacaucaacagcaccauccuggagaaggagaucugccccaaggccgccggcuacagaaacuggagcaagccccagugccagaucaucggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176036 - RNA, 1410 nt, Artificial Sequence
  derived and/or modified sequence opt4 from neuraminidase__InfluenzaA__AGQ81718
augaaccccaaccagaagaucaucgccaucggcagcgugagccugaccaucgccaccaucugccugcugaugcagaucgccauccuggugaccaccaugacccugcacuucaagcacaacgagugcaccaacagcagcaacaaccaggccgugcccugcggccccaucaucaucgagagaaaccugaccgagaucgugcaccugaacagcaccauccuggagaaggagaucugccccaaggccgccggcuacagaaacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccugagcaccaagcaggugugcaucgccuggagcagcagcagcugccacgacggcaaggccuggcugcacgugugcgugaccggcgacgacagaaacgccaccgccagcaucaucuacgacggcauccugguggacagcaucgugagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuaccccagauaccccgaggugagaugcgugugcagagacaacuggagaggcagcaacagacccgugcuguacaucaacauggccgacuacagcaucgacagcggcuacgugugcagcggccuggugggcgacacccccagaaacgacgacaccagcagcagcagcaacugcagagaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcguguucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176037 - RNA, 1410 nt, Artificial Sequence
  derived and/or modified sequence opt4 from neuraminidase__InfluenzaA__AGQ81719
augaaccccaaccagaagaucaucgccaucggcagcgugagccugaccaucgccaccaucugccugcugaugcagaucgccauccuggugaccaccaugacccugcacuucaagcacaacgagugcaccaacagcagcaacaaccaggccgugcccugcggccccaucaucaucgagagaaacgugaccgagaucgugcaccugaacagcaccacccuggagaaggagaucugcaccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccacccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcaacagcaacugcaaggaccccaacaacgagagcggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcaucgagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176038 - RNA, 1410 nt, Artificial Sequence
  derived and/or modified sequence opt4 from neuraminidase__InfluenzaA__AGQ81722
augaaccccaaccagaagaucaucgccaucggcagcgugagccugaccaucgccaccaucugccugcugaugcagaucgccauccuggugaccaccaugaccccccacuucaagcacgacgagugcaccaacagcagcaacaaccaggccgugcccugcggccccaucaucaucgagagaaacgugaccgagaucgugcacaucaacagcaccauccuggagaagggcaucugccccaaggccgccggcuacagaaacuggagcaagccccagugccagaucaucggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176039 - RNA, 1410 nt, Artificial Sequence
  derived and/or modified sequence opt4 from neuraminidase__InfluenzaA__AGQ81724
augaaccccaaccagaagaucaucgccaucggcagcgugagccugaccaucgccaccaucugccugcugaugcagaucgccauccuggugaccaccaugacccugcacuucaagcacaacgagugcagcaacagcagcaacaaccaggccgugcccugcggccccaucaucaucgagagaaacgugaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggaggacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176040 - RNA, 1410 nt, Artificial Sequence
  derived and/or modified sequence opt4 from neuraminidase__InfluenzaA__AGQ81726
augaaccccaaccagaagaucaucgccaucggcagcgugagccugaccaucgccaccaucugccugcugaugcagaucgccauccuggugaccaccaugacccugcacuucaagcacaacgagugcagcaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaagagaaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggagagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176041 - RNA, 1410 nt, Artificial Sequence
  derived and/or modified sequence opt4 from neuraminidase__InfluenzaA__AGQ81727
augaaccccaaccagaagaucaucgccaucggcagcgugagccugaccaucgccaccaucugccugcugaugcagguggccauccuggugaccaccaugacccugcacuucaagcacaacgagugcagcaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcagagccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggagagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176042 - RNA, 1410 nt, Artificial Sequence
  derived and/or modified sequence opt4 from neuraminidase__InfluenzaA__AGQ81728
augaaccccaaccagaagaucguggccaucggcagcgugagccugaccaucgccaccaugugccugcugaugcagaucgcccuguucgccaccaccaugacccugcacuucaagcagaccggcagcaccaacagcagcgacaaccaggccgugcccugcggccccaucaucaucgagagaaacaucaccgagaucgugcaccugaacagcaccacccuggagaaggagaccugccccaagagcgccggcuacagaaacuggagcaagccccagugccagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacaagcacagcaacggcaccaccuacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacaagaacgccaccgccagcaucaucuacgacggcauccugguggacagcaucgccagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgacagcagcuacgugugcagcggcaucgugggcgacacccccagaaacgacgacagaagcagcagcagcaacugcagagaccccaacaacgagaucggcgcccccggcgugaagggcugggccuucgacagcggcaacgacaucuggaugggcagaaccaucgagaaggacagcagaagcggcuacgagaccuucagagugaucggcggcuggagcaccgccaacagcaagagccagaucaacagacaggugaucguggacagagacaacagcagcggcuacagcggcaucuucagcguggagggcaagagcugcaucaacagaugcuucuacguggagcugaucagaggcagacccaaggagaacagagugugguggaccagcaacagcaucaucguguucugcggcaccagcggcaccuacggcaccggcagcuggcccgacggcgccaacaucaaccugaugcccaucuga

SEQ ID NO: 176043 - RNA, 1410 nt, Artificial Sequence
  derived and/or modified sequence opt4 from neuraminidase__InfluenzaA__AGQ81729
augaaccccaaccagaagaucaucgccaucggcagcgugagccugaccaucgccaccaucugccugcugaugcagaucgccauccugguggccaccaugacccugcacagcaagcacggcgagugcaccaacagcagcaacaaccaggccgugcccugcggccccaucaucaucgagagaaacgugaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcauccccuuccaccuggccaccaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugcugggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176044 - RNA, 1410 nt, Artificial Sequence
  derived and/or modified sequence opt4 from neuraminidase__InfluenzaA__AGQ81730
augaaccccaaccagaagaucaucgccaucggcagcgugagccugaccaucgccaccaucugccugcugaugcagaucgccauccuggugaccaccaugacccugcacuucaagcacaacgagugcaucaacagcagcaacaaccagagcgugcccugcggccccaucaucaucgagagaaacgugaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccagcaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcgaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176045 - RNA, 1410 nt, Artificial Sequence
  derived and/or modified sequence opt4 from neuraminidase__InfluenzaA__AGQ81731
augaaccccaaccagaagaucaucgccaucggcagcgugagccugaccaucgccaccaucugccugcugaugcagaucgccauccuggugaccaccaugacccugcacuucaagcacaacgagugcagcaacagcagcaacaaccaggccgugcccugcggccccaucaucaucgagagaaacaucaccgagaucgugcaccugaacagcaccacccuggagaaggagaucugccccaagaccgccggcuacagagacuggagcaagccccagugccagaucaccggcuucgcccccuucagcaaggacaacagcaucagacugagcgccagcggcgacaucugggugaccagagagcccuacgugagcugcggcuucggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacaugaccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggagagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176046 - RNA, 1410 nt, Artificial Sequence
  derived and/or modified sequence opt4 from neuraminidase__InfluenzaA__AGQ81732
augaaccccaaccagaagaucaucgccaucggcagcgugagccugaccaucgccaccaucugccugcugaugcagguggccauccuggugaccaccaugacccugcacuucaagcacaacgagugcagcaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggagagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176047 - RNA, 1410 nt, Artificial Sequence
  derived and/or modified sequence opt4 from neuraminidase__InfluenzaA__AGQ81733
augaaccccaaccagaagaucaucgccaucggcagcgugagccugaccaucgccaccaucugccugcugaugcagaucgccauccuggugaccaccaugacccugcacuucaagcacaacgagugcagcaacagcagcaacagccaggccgugcccugcggccccaucaucaucgagagaaacgugaccgagaucgugcaccugaacagcaccacccuggagaaggagaucugccccaaggccgccgaguacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176048 - RNA, 1410 nt, Artificial Sequence
  derived and/or modified sequence opt4 from neuraminidase__InfluenzaA__AGQ81734
augaaccccaaccagaagaucaucgccaucggcagcgugagccugaccaucgccaccaucugccugcugaugcagaucgccauccuggugaccaccaugacccugcacuucaagcacaacgaguacagcaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcaagugcgugugcaucaagagaaccugcaccguggugaagaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggagagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176049 - RNA, 1410 nt, Artificial Sequence; identical to SEQ ID NO: 176047
  derived and/or modified sequence opt4 from neuraminidase__InfluenzaA__AGQ81735

SEQ ID NO: 176050 - RNA, 1410 nt, Artificial Sequence
  derived and/or modified sequence opt4 from neuraminidase__InfluenzaA__AGQ81736
augaaccccaaccagaagaucaucgccaucggcagcgugagccugaccaucgccaccaucugccugcugaugcagaucgccauccugguggccaccaugacccugcacagcaagcacggcgagugcaccgacagcagcaacaaccaggccgugcccugcggccccaucaucaucgagagaaacgugaccgagaucgugcaccugaacagcaccacccuggagaaggagaucugccccaaggccgccggcuacaaggacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgcccacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176051 - RNA, 1410 nt, Artificial Sequence
  derived and/or modified sequence opt4 from neuraminidase__InfluenzaA__AGQ81737
augaaccccaaccagaagaucaucgccaucggcagcgugagccugaccaucgccaccaucugccugcugaugcagaucgccauccuggugaccaccaugacccugcacuucaagcacaacgagugcagcaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggagagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176052 - RNA, 1410 nt, Artificial Sequence
  derived and/or modified sequence opt4 from neuraminidase__InfluenzaA__AGQ81738
augaaccccaaccagaagaucaucgccaucggcagcgugagccugaccaucgccaccaucugccugcugaugcagguggccauccuggugaccaccaugacccugcacuucaagcacaacgagugcagcaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucauccacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggagagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176053 - RNA, 1410 nt, Artificial Sequence
  derived and/or modified sequence opt4 from neuraminidase__InfluenzaA__AGQ81739
augaaccccaaccagaagaucaucgccaucggcagcgugagccugaccaucgccaccaucugccugcugaugcagaucgccauccuggugaccaccaugacccugcacuucaagcacgacgagugcaccaacagcagcaacaaccaggccgugcccugcgagcccaucaucaucgagagaaacgugaccgagaucgugcacaucaacagcaccauccuggagaaggagaucugccccaaggccgccggcuacagaaacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcacccugaacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacgacaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucauggccaucuga

SEQ ID NO: 176054 - RNA, 1410 nt, Artificial Sequence
  derived and/or modified sequence opt4 from neuraminidase__InfluenzaA__AGQ81740
augaaccccaaccagaagaucguggccaucggcagcgugagccugaccaucgccaccaucugccugcugaugcagaucgccauccuggugaccaccaugacccugcacuucaagcacggcgagugcaccaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacaacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggaccugagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176055 - RNA, 1410 nt, Artificial Sequence
  derived and/or modified sequence opt4 from neuraminidase__InfluenzaA__AGQ81741
augaaccccaaccagaagaucguggccaucggcagcgugagccugaccaucgccaccaucugccugcugaugcagaucgccauccuggugaccaccaugacccugcacuucaagcacggcgagugcaccaacagcagcaacaaccaggccgugcccugcggccccaucaucaucgagagaaacaucaccgagaucgugcaccugaacagcaccacccuggacaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggaccugagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176056 - RNA, 1410 nt, Artificial Sequence
  derived and/or modified sequence opt4 from neuraminidase__InfluenzaA__AGQ81742
augaaccccaaccagaagaucguggccaucggcagcgugagccugaccaucgccaccaucugccugcugaugcagaucgccauccuggugaccaccaugacccugcacuucaagcacggcgagugcaccaacagcagcaacaaccaggccgugcccugcggccccaucaucaucgagagaaacaucaccgagaucgugcaccugaacagcaccacccuggagaaggagaucugccccaaggccgccgaguacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggaccugagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176057 - RNA, 1410 nt, Artificial Sequence
  derived and/or modified sequence opt4 from neuraminidase__InfluenzaA__AGQ81744
augaaccccaaccagaagaucaucgccaucggcagcgugagccugaccaucgccaccaucugccugcugaugcagaucgccauccuggugaccaccaugacccugcacuucagacacgacgagugcaccaacagcagcaacaaccaggccgugcccugcggccccaucaucaucgagagaaacgugaccgagaucgugcaccugaacagcaccacccuggagaaggagaucugccccaaggccgccgaguacagagacuggagcaagccccagugccagaucaccggcuucgugcccuucagcaaggacaacagcaucagacugagcgccggcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacguggccgacuacagcguggacagcggcuacgugugcagcggccuggugggcgacacccccagaaacgacgacaucagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaaccccagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176058 - RNA, 1410 nt, Artificial Sequence
  derived and/or modified sequence opt4 from neuraminidase__InfluenzaA__AGQ81746
augaaccccaaccagaagaucaucgccaucggcagcgugagccugaccaucgccaccaucugccugcugaugcagaucgccauccuggugaccaccaugacccugcacuucaagcacaacgagugcagcaacagcagcaacagccaggccgugcccugcggccccaucaucaucgagagaaacgugaccgagaucgugcaccugaacagcaccacccuggagaaggagaucugccccaaggccgccgaguacagaggcuggagcaagccccagugccagaucaccggcuucgcccccuucagcaaggacaacagcaucagacugagcgccagcggcgacaucugggugaccagagagcccuacgugagcugcgaccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176059 - RNA, 1410 nt, Artificial Sequence
  derived and/or modified sequence opt4 from neuraminidase__InfluenzaA__AGQ81747
augaaccccaaccagaagaucguggccaucggcagcgugagccugaccaucgccaccaucugccugcugaugcagaucgccauccuggugaccaccaugacccugcacuucaagcacggcgagugcaccaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggaccugagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176060 - RNA, 1401 nt, Artificial Sequence
  derived and/or modified sequence opt4 from neuraminidase__InfluenzaA__AGQ81749
augaaccccaaccagaagaucaucgccaucggcagcgugagccugaccaccgccaucaucugcuuccugaugcagaucgccauccugaccaccaccaugacccugcacuucaagcagaacgagugcagcaaccccagcaacaaccagguggugcccugcgagcccaucaucaucgagagaaacaccgugcaccugaacagcaccaccaucgagaaggagaucugcagcaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcuggccgacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcagaaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaaggacagcagaagcggcuacgagaccuucagagugaucaacggcuggaccaccgccaacagcaagagccagaucaacagacaggugaucguggacagcgacaacuggagcggcuacagcggcaucuucagcguggagggcaagaacugcaucaacagaugcuucuacguggagcugaucagaggcagaccccaggagcccaaggugugguggaccagcaacagcaucaucgccuucugcggcaccagcggcaccuacggcaccggcagcuggcccgacggcgccaacaucaacuucaugcccaucuga

SEQ ID NO: 176061 - RNA, 1401 nt, Artificial Sequence; identical to SEQ ID NO: 176060
  derived and/or modified sequence opt4 from neuraminidase__InfluenzaA__AGQ81750

SEQ ID NO: 176062 - RNA, 1410 nt, Artificial Sequence
  derived and/or modified sequence opt4 from neuraminidase__InfluenzaA__AGQ81751
augaaccccaaccagaagaucaucgccaucggcagcgugagccugaccaucgccaccaucugccugcugaugcagaucgccauccuggugaccaccaugacccuguacuucaagcacaacgagugcagcaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacaucagcagcagcagcaacugcaaggaccccaacaacgagagaggcgcccccggcgugaagggcugggccuucgacagcggcaacgaccuguggaugggcagaaccaucgagaaggagagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176063 - RNA, 1410 nt, Artificial Sequence
  derived and/or modified sequence opt4 from neuraminidase__InfluenzaA__AGQ81753
augaaccccaaccagaagaucguggccaucggcagcgugagccugaccaucgccaccaucugccugcugaugcagaucgccauccuggugaccaccaugacccugcacuucaagcacggcgagugcaccaacagcagcaacaaccaggccgugcccugcggccccaucaucaucgagagaaacaucaccggcaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacaucugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggaccugagaagcggcuacgagaccuucagagugaucggcggcuggaacaccgccaacagcaagagccagaccaacagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176064 - RNA, 1410 nt, Artificial Sequence; identical to SEQ ID NO: 176063
  derived and/or modified sequence opt4 from neuraminidase__InfluenzaA__AGQ81754

SEQ ID NO: 176065 - RNA, 1410 nt, Artificial Sequence
  derived and/or modified sequence opt4 from neuraminidase__InfluenzaA__AGQ81756
augaaccccaaccagaagaucaucgccaucggcagcaucagccugaccaucgccaccaucugccugcugauccagaucgccauccuggugaccaccaugacccugcacuucaagcacggcgagugcaccaacagcagcaacaaccaggccgugcccugcggccccaucaucaucgagagaaacgugaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggccugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucauccacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176066 - RNA, 1410 nt, Artificial Sequence
  derived and/or modified sequence opt4 from neuraminidase__InfluenzaA__AGQ81757
augaaccccaaccagaagaucaucgccaucggcagcgugagccugaccaucgccaccaucugccugcugauccagaucgccauccuggugaccaccaugacccugcacuucaagcacggcgagugcaccaacagcagcaacaaccaggccgugcccugcggccccaucaucaucgagagaaacgugaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggccugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucauccacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggacagcagaagcggcuacgagaccuucagagugaucggcggcuggaacaccgccaacagcaagagccagaccagcagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176067 - RNA, 1401 nt, Artificial Sequence
  derived and/or modified sequence opt4 from neuraminidase__InfluenzaA__AGQ81758
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccagguggugcccugcgagcccaccaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacgagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacgacagcagaagcggcuacgagaccuucagaguggugaacggcuggaccauggccaacagcaagagccagaucaacagacaggugaucguggacagcgacaacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176068 - RNA, 1401 nt, Artificial Sequence
  derived and/or modified sequence opt4 from neuraminidase__InfluenzaA__AGQ81759
augaaccccaaccagaagaucaucgccaucggcagcgugagccugaccaucgccaucaucugcuuccugauccagaucgccauccugaccaccaccaugacccugcacuucagacagagcgagugcagcaaccccagcaacaaccagguggugcccugcgagcccaucaucaucgagagaaacaccgugcaccugaacagcaccaucaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagagugaucaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagacccagagagaccagagugugguggaccagcaacagcaucaucguguucugcggcaccagcggcaccuacggcaccggcagcuggcccgacggcgccaacaucaacuucaugcccaucuga

SEQ ID NO: 176069 - RNA, 1401 nt, Artificial Sequence
  derived and/or modified sequence opt4 from neuraminidase__InfluenzaA__AGQ81760
augaaccccaaccagaagaucaucgccaucggcagcgugagccugaccaucgccaucaucugcuuccugaugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaucaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 176070 - RNA, 1401 nt, Artificial Sequence
  derived and/or modified sequence opt4 from neuraminidase__InfluenzaA__AGQ81761
augaaccccaaccagaagaucaucgccaucggcagcgugagccugaccaucgccaucaucugcuuccugaugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucaaggagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 176071 - RNA, 1401 nt, Artificial Sequence
  derived and/or modified sequence opt4 from neuraminidase__InfluenzaA__AGQ81763
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacaacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176072 - RNA, 1401 nt, Artificial Sequence
  derived and/or modified sequence opt4 from neuraminidase__InfluenzaA__AGQ81766
augaaccccaaccagaagaucaucgccaucggcagcgugagccugaccaucgccaucaucugcuuccugaugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcuucagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccaucgugugguggaccagcaacagcaucaucguguucugcggcaccagcggcaccuacggcaccggcagcuggcccgacggcgccaacaucaacuucaugcccaucuga

SEQ ID NO: 176073 - RNA, 1401 nt, Artificial Sequence; identical to SEQ ID NO: 176072
  derived and/or modified sequence opt4 from neuraminidase__InfluenzaA__AGQ81767

SEQ ID NO: 176074 - RNA, 1410 nt, Artificial Sequence
  derived and/or modified sequence opt4 from neuraminidase__InfluenzaA__AGQ81768
augaaccccaaccagaagaucguggccaucggcagcgugagccugaccaucgccaccaucugccugcugaugcagaucgccauccuggugaccaccaugacccugcacuucaagcacggcgagugcaccaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugagcgagcugggcgugcccuuccaccuggccaccaagcaggugugcaucgccuggagcagcagcagcugccacgacggcgaggccuggcugcacaucugcgugaccggcgacgacagaaacgccaccgccagcaucaucuacgacggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggaccugagaagcggcuacgagaccuucagagugaucggcggcuggaacaccgccaacagcaagagccagaccaacagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176075 - RNA, 1410 nt, Artificial Sequence
  derived and/or modified sequence opt4 from neuraminidase__InfluenzaA__AGQ81769
augaaccccaaccagaagaucguggccaucggcagcgugagccugaccaucgccaccaucugccugcugaugcagaucgccauccuggugaccaccaugacccugcacuucaagcacggcgagugcaccaacagcagcaacaaccaggccgugcccugcggccccaucaucaucgagagaaacaucaccgagaucgugcaccugaacagcaccacccuggagaaggagaucugccccaaggccgccggcuacagagacuggagcaagccccagugccagaucaccggcuucgcccccuucagcaaggacaacagcaucagacugagcgccagcggcgacaucugggugaccagagagcccuacgugagcugcggccugggcaagugcuaccaguucgcccugggccagggcaccacccuggacaacagacacagcaacggcaccagccacgacagaaccccccacagaacccugcugaugagcgagcugggcgugcccuuccaccuggccaccaagcaggugugcaucgccuggagcagcagcagcugccacgacggcgaggccuggcugcacaucugcgugaccggcgacgacagaaacgccaccgccagcaucaucuacggcggcaugcugguggacagcaucggcagcuggagcaagaacauccugagaacccaggagagcgagugcgugugcaucaacggcaccugcaccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcguggacagcggcuacgugugcagcggccuggugggcgacacccccagaaacgacgacaccagcagcagcagcaacugcaaggaccccaacaacgagagaggcgcccccggcgugaagggcugggccuucgacagcggcaacgacaucuggaugggcagaaccaucgagaaggaccugagaagcggcuacgagaccuucagagugaucggcggcuggaacaccgccaacagcaagagccagaccaacagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176076 - RNA, 1401 nt, Artificial Sequence
  derived and/or modified sequence opt4 from neuraminidase__InfluenzaA__AGQ81770
augaaccccaaccagaagaucaucgccaucggcagcgugagcaucaccaucgccaucaucugcuucaucaugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagaaggagaccugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 176077 - RNA, 1410 nt, Artificial Sequence
  derived and/or modified sequence opt4 from neuraminidase__InfluenzaA__AGQ81772
augaaccccaaccagaagaucguggccaucggcagcgccagccugaccaucgccaccaugugccugcugcugcagaucgcccuguucgccaccaccaugacccugcacuucaagcagaccggcugcaccaacagcagcgacaaccaggccgugcccugcggccccaucaucaucgagagaaacaucaccgagaucgugcaccugaacagcaccacccuggagaaggagaccugccccaagagcgccggcuacagaaacuggagcaagccccagugccagaucaccggcuucgcccccuucagcaaggacaacagcaucagacuggccgccgccggcgacaucugggugaccagagagcccuacgugagcugcggccugggcaagugcuaccaguucgcccugggccagggcaccacccuggacaacaagcacagcaacggcaccacccacgacagaaccccccacagaacccugcugaugagcgagcugggcgugcccuuccaccuggccaccaagcaggugugcaucgccuggagcagcagcagcugccacgacggcaaggccuggcugcacgugugcgugaccggcgacgacaagaacgccaccgccagcaucaucuacgacggcauccugguggacagcaucgccagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguucaucaacauggccgacuacagcaucgacagcagcuacgugugccccggccuggugggcgacacccccagaaacgacgacagaagcagcagcagcaacugcagagaccccaacaacgagagaggcgcccccggcgugaagggcugggccuucgacagcggcaacgacaucuggaugggcagaaccaucgagaaggacagcagaagcggcuacgagaccuucagagugaucagcggcuggagcaccgccaacagcaagagccagaucaacagacaggugaucguggacagagacaacagcagcggcuacagcggcaucuucagcguggagggcaagagcugcaucaacagaugcuucuacguggagcugaucagaggcagacccaaggagaacagagugugguggaccagcaacagcaucaucguguucugcggcaccagcggcaccuacggcaccggcagcuggcccgacggcgccaacaucaaccugaugcccaucuga

SEQ ID NO: 176078 - RNA, 1401 nt, Artificial Sequence
  derived and/or modified sequence opt4 from neuraminidase__InfluenzaA__AGQ81773
augaaccccaaccagaagaucaucgccaucggcagcgugagccugaccaucgccaucaucugcuuccugaugcagaucgccauccugaccaccaccaugacccugcacuucagacagaacgagugcagcaaccccagcaacaaccagguggugcccugcgagcccaucaucaucgagagaaagaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugccccugcacuggggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcuggggcuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 176079 - RNA, 1401 nt, Artificial Sequence
  derived and/or modified sequence opt4 from neuraminidase__InfluenzaA__AGQ81774
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccaucgccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176080 - RNA, 1401 nt, Artificial Sequence
  derived and/or modified sequence opt4 from neuraminidase__InfluenzaA__AGQ81776
augaaccccaaccagaagaucaucgccaucggcagcgugagccugaccaucgccaucaucugcuuccugaugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagagugaucgacggcuggaccaccgccgacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 176081 - RNA, 1410 nt, Artificial Sequence
  derived and/or modified sequence opt4 from neuraminidase__InfluenzaA__AGQ81777
augaaccccaaccagaagaucgugaccaucggcagcgccagccugaccaucgccaccaugugccugcugcugcagaucgcccuguucgccaccaccaugacccugcacuucaagcagaccggcugcaccaacagcagcgacaaccaggccgugcccugcggccccaucaucaucgagagaaacaucaccgagaucgugcaccugaacagcaccacccuggagaaggagaccugccccaagagcgccggcuacagaaacuggagcaagccccagugccagaucaccggcuucgcccccuucagcaaggacaacagcaucagacuggccgccgccggcgacaucugggugaccagagagcccuacgugagcugcggccugggcaagugcuaccaguucgcccugggccagggcaccacccuggacaacaagcacagcaacggcaccacccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacaagaacgccaccgccagcaucaucuacgacggcauccugguggacagcaucgccagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgaggugagaugcgugugcagagacaacuggaacggcagcaacagacccgugcuguucaucaacauggccgacuacagcaucgacagcagcuacgugugcagcggccuggugggcgacacccccagaaacgacgacagaagcagcagcagcaacugcagagaccccaacaacgagagaggcgcccccggcgugaagggcugggccuucgacagcggcaacgacaucuggaugggcagaaccaucgagaaggacagcagaagcggcuacgagaccuucagagugaucagcggcuggagcaccgccaacagcaagagccagaucaacagacaggugaucguggacagagacaacagcagcggcuacagcggcaucuucagcguggagggcaagagcugcaucaacagaugcuucuacguggagcugaucagaggcagacccaaggagaacagagugugguggaccagcaacagcaucaucguguucugcggcaccagcggcaccuacggcaccggcagcuggcccgacggcgccaacaucaaccugaugcccaucuga

SEQ ID NO: 176082 - RNA, 1410 nt, Artificial Sequence
  derived and/or modified sequence opt4 from neuraminidase__InfluenzaA__AGQ81778
augaaccccaaccagaagaucgugaccaucggcagcgccagccugaccaucgccaccaugugccugcugcugcagaucgcccuguucgccaccaccaugacccugcacuucaagcagaccggcugcaccaacagcagcgacaaccaggccgugcccugcggccccaucaucaucgagagaaacaucaccgagaucgugcaccugaacagcaccacccuggagaaggagaccugccccaagagcgccggcuacagaaacuggagcaagccccagugccagaucaccggcuucgcccccuucagcaaggacaacagcaucagacuggccgccgccggcgacaucugggugaccagagagcccuacgugagcugcggccugggcaagugcuaccaguucgcccugggccagggcaccacccuggacaacaagcacagcaacggcaccacccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacaagaacgccaccgccagcaucaucuacgacggcauccugguggacagcaucgccagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguucaucaacauggccgacuacagcaucgacagcagcuacgugugcagcggccuggugggcgacacccccagaaacgacgacagaagcagcagcagcaacugcagagaccccaacaacgagagaggcgcccccggcgugaagggcugggccuucgacagcggcaacgacaucuggaugggcagaaccaucgagaaggacagcagaagcggcuacgagaccuucagagugaucagcggcuggagcaccgccaacagcaagagccagaucaacagacaggugaucguggacagagacaacagcagcggcuacagcggcaucuucagcguggagggcaagagcugcaucaacagaugcuucuacguggagcugaucagaggcagacccaaggagaacagagugugguggaccagcaacagcaucaucguguucugcggcaccagcggcaccuacggcaccggcagcuggcccgacggcgccaacaucaaccugaugcccaucuga

SEQ ID NO: 176083 - RNA, 1410 nt, Artificial Sequence
  derived and/or modified sequence opt4 from neuraminidase__InfluenzaA__AGQ81779
augaaccccaaccagaagaucguggccaucggcagcgccagccugaccaucgccaccaugugccugcugcugcagaucgcccuguucgccaccaccaugacccugcacuucaagcagaccggcugcaccaacagcagcgacaaccaggccgugcccugcggccccaucaucaucgagagaaacaucaccgagaucgugcaccugaacagcaccacccuggagaaggagaccugccccaagagcgccggcuacagaaacuggagcaagccccagugccagaucaccggcuucgcccccuucagcaaggacaacagcaucagacuggccgccgccggcgacaucugggugaccagagagcccuacgugagcugcggccugggcaagugcuaccaguucgcccugggccagggcaccacccuggacaacaagcacagcaacggcaccacccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacaagaacgccaccgccagcaucaucuacgacggcauccugguggacagcaucgccagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgagaucagaugcgugugcagagacaacuggaagggcagcaacagacccgugcuguucaucaacauggccgacuacagcaucgacagcagcuacgugugcagcggccuggugggcgacacccccagaaacgacgacagaagcagcagcagcaacugcagagaccccaacaacgagagaggcgcccccggcgugaagggcugggccuucgacagcggcaacgacaucuggaugggcagaaccaucgagaaggacagcagaagcggcuacgagaccuucagagugaucagcggcuggagcaccgccaacagcaagagccagaucaacagacaggugaucguggacagagacaacagcagcggcuacagcggcaucuucagcguggagggcaagagcugcaucaacagaugcuucuacguggagcugaucagaggcagacccaaggagaacagagugugguggaccagcaacagcaucaucguguucugcggcaccagcggcaccuacggcaccggcagcuggcccgacggcgccaacaucaaccugaugcccaucuga

SEQ ID NO: 176084 - RNA, 1410 nt, Artificial Sequence
  derived and/or modified sequence opt4 from neuraminidase__InfluenzaA__AGQ81780
augaaccccaaccagaagaucguggccaucggcagcgccagccugaccaucgccaccaugugccugcugcugcagaucgcccuguucgccaccaccaugacccugcacuucaagcagaccggcugcaccaacagcagcgacaaccaggccgugcccugcggccccaucaucaucgagagaaacaucaccgagaucgugcaccugaacagcaccacccuggagaaggagaccugccccaagagcgccggcuacagaaacuggagcaagccccagugccagaucaccggcuucgcccccuucagcaaggacaacagcaucagacuggccgccgccggcgacaucugggugaccagagagcccuacgugagcugcggccugggcaagugcuaccaguucgcccugggccagggcaccacccuggacaacaagcacagcaacggcaccacccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacaagaacgccaccgccagcaucaucuacgacggcauccugguggacagcaucgccagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguucaucaacauggccgacuacagcaucgacagcagcuacgugugcagcggccuggugggcgacacccccagaaacgacgacagaagcagcagcagcaacugcagagaccccaacaacgagagaggcgccagcggcgugaagggcugggccuucgacagcggcaacgacaucuggaugggcagaaccaucgagaaggacagcagaagcggcuacgagaccuucagagugaucagcggcuggagcaccgccaacagcaagagccagaucaacagacaggugaucguggacagagacaacagcagcggcuacagcggcaucuucagcguggagggcaagagcugcaucaacagaugcuucuacguggagcugaucagaggcagacccaaggagaacagagugugguggaccagcaacagcaucaucguguucugcggcaccagcggcaccuacggcaccggcagcuggcccgacggcgccaacaucaaccugaugcccaucuga

SEQ ID NO: 176085 - RNA, 1401 nt, Artificial Sequence
  derived and/or modified sequence opt4 from neuraminidase__InfluenzaA__AGQ81781
augaaccccaaccagaagaucaucgccaucggcagcgugagccugaccaucgccaucaucugcuuccugaugcagaucgccauccugaccaccaccaugaccccccacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccgacaucaaccugaugcccaucuga

SEQ ID NO: 176086 - RNA, 1410 nt, Artificial Sequence
  derived and/or modified sequence opt4 from neuraminidase__InfluenzaA__AGQ81783
augaaccccaaccagaagaucgugaccaucggcagcgccagccugaccaucgccaccaugugccugcugcugcagaucgcccuguucgccaccaccaugacccugcacuucaagcagaccggcugcaccaacagcagcgacaaccaggccgugcccugcggccccaucaucaucgagagaaacaucaccgagaucgugcaccugaacagcaccacccuggagaaggagaccugccccaagagcgccggcuacagaaacuggagcaagccccagugccagaucaccggcuucgcccccuucagcaaggacaacagcaucagacuggccgccgccggcgacaucugggugaccagagagcccuacgugagcugcggccugggcaagugcuaccaguucgcccugggccagggcaccacccuggacaacaagcacagcaacggcaccacccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacaagaacgccaccgccagcaucaucuacaacggcauccugguggacagcaucgccagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguucaucaacauggccgacuacagcaucgacagcagcuacgugugcagcggccuggugggcgacacccccagaaacgacgacagaagcagcagcagcaacugcagagaccccaacaacgagagaggcgcccccggcgugaagggcugggccuucgacagcggcaacgacaucuggaugggcagaaccaucgagaaggacagcagaagcggcuacgagaccuucagagugaucagcggcuggagcaccgccaacagcaagagccagaucaacagacaggugaucguggacagagacaacagcagcggcuacagcggcaucuucagcguggagggcaagagcugcaucaacagaugcuucuacguggagcugaucagaggcagacccaaggagaacagagugugguggaccagcaacagcaucaucguguucugcggcaccagcggcaccuacggcaccggcagcuggcccgacggcgccaacaucaaccugaugcccaucuga

SEQ ID NO: 176087 - RNA, 1401 nt, Artificial Sequence
  derived and/or modified sequence opt4 from neuraminidase__InfluenzaA__AGQ81784
augaaccccaaccagaagaucaucgccaucggcagcgugagccugaccaucgccaucaucugcuuccugaugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugagaaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcaacgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccgacaucaacuucaugcccaucuga

SEQ ID NO: 176088 - RNA, 1401 nt, Artificial Sequence
  derived and/or modified sequence opt4 from neuraminidase__InfluenzaA__AGQ81785
augaaccccaaccagaagaucaucgccaucggcagcgugagccugaccaucgccaucaucugcuucaucaugcagaucgccauccugaccaccaccaugaccccccacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccgacaucaaccugaugcccaucuga

SEQ ID NO: 176089 - RNA, 1401 nt, Artificial Sequence
  derived and/or modified sequence opt4 from neuraminidase__InfluenzaA__AGQ81787
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176090 - RNA, 1401 nt, Artificial Sequence
  derived and/or modified sequence opt4 from neuraminidase__InfluenzaA__AGQ81789
augaaccccaaccagaagaucaucgccaucggcagcgugagccugaccaucgccaucaucugccugcugaugcagaucgccauccugaccaccaccaugaccccccacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccgacaucaaccugaugcccaucuga

SEQ ID NO: 176091 - RNA, 1401 nt, Artificial Sequence
  derived and/or modified sequence opt4 from neuraminidase__InfluenzaA__AGQ81790
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggccaugcccugcgagcccaucaucaucgagagaaacaccgugcaccugaacagcaccaccaucgagagagagaucugccccaaggugaccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcagagccgacaccagagugcuguucaucagagagggcaagaucaucaacaucagcccccugagcggcaacgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgaguggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176092 - RNA, 1401 nt, Artificial Sequence
  derived and/or modified sequence opt4 from neuraminidase__InfluenzaA__AGQ81792
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugaacaagugcuaccaguucgcccugggccagggcaccacccuggagaacaagcacagcaacggcaccacccacgacagaaccccccacagaacccugcugaugaacgagcugggcgugcccuuccaccugggcaccaagcaggugugcauggccuggagcagcagcagcugcuacgacggcaaggccuggcugcacaucugcgugaccggcgacgacaagaacgccaccgccagcgugaucuacgacggcaugcugguggacagcaucggcagcuggagccagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176093 - RNA, 1401 nt, Artificial Sequence
  derived and/or modified sequence opt4 from neuraminidase__InfluenzaA__AGQ81793
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugaacaagugcuaccaguucgcccugggccagggcaccacccuggagaacaagcacagcaacggcaccacccacgacagaaccccccacagaacccugcugaugaacgagcugggcgugcccuuccaccugggcaccaagcaggugugcauggccuggagcagcagcagcugcuacgacggcaaggccuggcugcacaucugcgugaccggcgacgacaagaacgccaccgccagcgugaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176094 - RNA, 1401 nt, Artificial Sequence; identical to SEQ ID NO: 176093
  derived and/or modified sequence opt4 from neuraminidase__InfluenzaA__AGQ81794

SEQ ID NO: 176095 - RNA, 1401 nt, Artificial Sequence
  derived and/or modified sequence opt4 from neuraminidase__InfluenzaA__AGQ81795
augaaccccaaccagaagaucaucgccaucggcagcgugagccugaucaucgccaucaucugccugcugaugcagaucgccauccugaccaccaccaugacccugcacuucagacagaacgagugcaacaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccaucgccaacagcaagagccagaucaacagacagaucaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176096 - RNA, 1401 nt, Artificial Sequence
  derived and/or modified sequence opt4 from neuraminidase__InfluenzaA__AGQ81796
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacaucuggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176097 - RNA, 1401 nt, Artificial Sequence
  derived and/or modified sequence opt4 from neuraminidase__InfluenzaA__AGQ81798
augaaccccaaccagaagaucaucagcaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176098 - RNA, 1401 nt, Artificial Sequence
  derived and/or modified sequence opt4 from neuraminidase__InfluenzaA__AGQ81799
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176099 - RNA, 1401 nt, Artificial Sequence; identical to SEQ ID NO: 176098
  derived and/or modified sequence opt4 from neuraminidase__InfluenzaA__AGQ81800

SEQ ID NO: 176100 - RNA, 1401 nt, Artificial Sequence
  derived and/or modified sequence opt4 from neuraminidase__InfluenzaA__AGQ81801
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccagcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176101 - RNA, 1401 nt, Artificial Sequence
  derived and/or modified sequence opt4 from neuraminidase__InfluenzaA__AGQ81802
augaaccccaaccagaagaucaucgccaucggcagcgugagccugaucaucgccaucaucugccugcugaugcagaucgcccugcugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacaacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcgagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176102 - RNA, 1401 nt, Artificial Sequence
  derived and/or modified sequence opt4 from neuraminidase__InfluenzaA__AGQ81803
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccagcggcgacaucugggugaccagagagcccuacgugagcugcagccuggacaagugcuaccaguucgcccugggccagggcaccacccugaagaacgagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaucauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176103 - RNA, 1410 nt, Artificial Sequence
  derived and/or modified sequence opt4 from neuraminidase__InfluenzaA__AGQ81804
augaaccccaaccagaagaugaucgccaucggcgccgugagccugaccaucgccaucaucugccugcugaugcagaccgccauccuggugaccaccaugacccugcacuucaagcacaacgagugcaccaacagcagcaacaaccaggccgcccccugcggccccaucaucaucgagagaaacgugaccgagguggugcaccugaacagcaccacccuggagaaggagaucugccccaaggccgccggcuacagaaacuggagcaagccccagugccagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccagccacgacagaaccccccacagaacccugcugaugaacgagcugggcgugcccuuccaccugaugaccaagcaggugugcaucgccuggagcagcagcagcugccacgacggcaaggccuggcugcacgugugcgugaccggcgacgacagaaacgccaccgccagcaucaucuacggcggcauccugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucgugcacaucagcccccugagcggcagcgcccagcacguggaggagugcagcugcuacccccaguaccccgaggugagaugcgugugcagagacaacuggagaggcagcaacagacccgugcuguacaucaacauggccgacuacagcaucgacagcggcuacgugugcagcggccuggugggcgacacccccagaaacgacgacgugagcagcagcagcaacugcaaggaccccaacaacgagagaggcgcccccggcgugaagggcugggccuucgacaacggcaacgacaucuggaugggcagaaccaucgacaaggacagcagaagcggcuacgagaccuucagagugaucgacggcuggaacaccgccaacagcaagagccagaccagcagacaggugaucgugggcagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 176104 - RNA, 1401 nt, Artificial Sequence
  derived and/or modified sequence opt4 from neuraminidase__InfluenzaA__AGQ81805
augaaccccaaccagaagaucaucgccaucggcagcgugagccugaucaucgccaucaucugccugcugaugcagaucgcccugcugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccaccaugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagaggccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176105 - RNA, 1401 nt, Artificial Sequence
  derived and/or modified sequence opt4 from neuraminidase__InfluenzaA__AGQ81807
augaaccccaaccagaagaucaccgccaucggcagcaucagccugaucaucgccaucaucugccugcugaugcagaucgccauccugaccaccaccaugacccugcacuucagacagaacgagugcagaaaccccagcaacaaccaggugaugcccugcgagcccgugaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccagcggcgacaucugggugaccagagagcccuacgugagcugcagccugaacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucaaggagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaucauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176106 - RNA, 1401 nt, Artificial Sequence
  derived and/or modified sequence opt4 from neuraminidase__InfluenzaA__AGQ81808
augaaccccaaccagaagaucaucgccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaaccacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucagaaacaacagcagaagcggcuacgagaccuucagaguggugaacggcuggaccaccgccaacagcaagagccagaucaacagacagaucaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176107 - RNA, 1401 nt, Artificial Sequence
  derived and/or modified sequence opt4 from neuraminidase__InfluenzaA__AGQ81809
augaaccccaaccagaagaucaccgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccccgacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcgaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccaucaucuacaucaacaugguggacuacagcaucggcagcagauacgugugcagcggccuggugggcgacacccccagaaacgacgacagcaccagcagcagcaacugcagagaccccaacaacgagagaggcgcccccggcgugaagggcugggccuucgacgacggcaacgacguguggaugggcagaaccaucaagaacggcagcagaagcggcuacgagaccuucagagugaucaacggcuggaccauggccaacagcaagagccagaucaacagacaggugaucguggacagcgacaacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccgacaucaacuucaugcccaucuga

SEQ ID NO: 176108 - RNA, 1401 nt, Artificial Sequence
  derived and/or modified sequence opt4 from neuraminidase__InfluenzaA__AGQ81810
augaaccccaaccagaagauccuggccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaaccacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucagaaacaacagcagaagcggcuacgagaccuucagaguggugaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176109 - RNA, 1401 nt, Artificial Sequence
  derived and/or modified sequence opt4 from neuraminidase__InfluenzaA__AGQ81811
augaaccccaaccagaagaucaucgccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucgugaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcuucagcagcagcaacugcagagaccccaacaacgagagaggcgcccccggcgugaagggcugggccuucgacgacggcaacgacguguggaugggcagaaccaucagaaacgacagcagaagcggcuacgagaccuucagaguggugaacggcuggaccaccgccaacagcaagagccagaucaacagacaggugaucguggacagcgagagcuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176110 - RNA, 1410 nt, Artificial Sequence
  derived and/or modified sequence opt4 from neuraminidase__InfluenzaA__AGQ81812
augaaccccaaccagaagaucaucaccaucggcagcgugagccugaccaucgccaccaucugcuuccugaugcagaucgccauccuggugaccaccaucacccugcacuucaagcagaacgagugcagcauccccagcaacaaccagguggugcccugcgagcccaucaucguggagagaaacaucaccgagaucguguaccugaacaacaccaccaucgagaaggagcugugccccaagcugaccgaguacagagacuggagcaagccccagugccagaucaccggcuucgcccccuucagcaaggacaacagcaucagacugagcgccggcggcgacaucugggugaccagagagcccuacgugagcugcagccccaacaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcaucgccuggagcagcagcagcugccacgacggcaaggccuggcugcacgugugcgugaccggcgacgacagaaacgccaccgccagcuucaucuacgacggcaugcugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacgugagcccccugagcggcagcgcccagcacaucgaggagugcagcugcuaccccagauaccccgacgugagaugcgugugcagagacaacuggaagggcagcaacagacccaucaucgacaucaacguggccgacuacagcaucgacagcagcuacgugugcagcggccuggugggcgacacccccagaaacgacgacagcagcagcaacagcaacugcaaggaccccaacaacgagagaggcaaccccggcgugaagggcugggccuucgacuacggcaacgacguguggaugggcagaaccaucagcaaggacagcagaagcggcuacgagaccuucagagugaucggcggcuggaccaccgccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 176111 - RNA, 1401 nt, Artificial Sequence
  derived and/or modified sequence opt4 from neuraminidase__InfluenzaA__AGQ81814
augaaccccaaccagaagaucaucgccaucggcagcgugagccugaccaucgccaucaugugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaaccacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucagaaacaacagcagaagcggcuacgagaccuucagaguggugaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176112 - RNA, 1401 nt, Artificial Sequence
  derived and/or modified sequence opt4 from neuraminidase__InfluenzaA__AGQ81815
augaaccccaaccagaagaucaucgccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcacccccggcgugaagggcugggccuucgacgacggcaacgacguguggaugggcagaaccaucagaaacgacagcagaagcggcuacgagaccuucagagugaucaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuacaugcccaucuga

SEQ ID NO: 176113 - RNA, 1401 nt, Artificial Sequence
  derived and/or modified sequence opt4 from neuraminidase__InfluenzaA__AGQ81816
augaaccccaaccagaagaucaucgccaucggcagcgugagccugaccaucgccaucaucugcuuccugaugcagaucgccauccugaccaccaccaugacccugcacuucaagcagaacggcugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcacccccggcgugaagggcugggccuucgacgacggcaacgacguguggaugggcagaaccaucagaaacgacagcagaagcggcuacgagaccuucagagugaucaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuacaugcccaucuga

SEQ ID NO: 176114 - RNA, 1401 nt, Artificial Sequence; identical to SEQ ID NO: 176112
  derived and/or modified sequence opt4 from neuraminidase__InfluenzaA__AGQ81817

SEQ ID NO: 176115 - RNA, 1401 nt, Artificial Sequence; identical to SEQ ID NO: 176112
  derived and/or modified sequence opt4 from neuraminidase__InfluenzaA__AGQ81818

SEQ ID NO: 176116 - RNA, 1401 nt, Artificial Sequence; identical to SEQ ID NO: 176112
  derived and/or modified sequence opt4 from neuraminidase__InfluenzaA__AGQ81819

SEQ ID NO: 176117 - RNA, 1401 nt, Artificial Sequence
  derived and/or modified sequence opt4 from neuraminidase__InfluenzaA__AGQ81820
augaaccccaaccagaagaucaucgccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagaaacgacgacagcagcagcagcagcaacugcagagaccccaacaacgagagaggcacccccggcgugaagggcugggccuucgacgacggcaacgacguguggaugggcagaaccaucagaaacgacagcagaagcggcuacgagaccuucagagugaucaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccaaggugugguggaccagcaacagcaucaucguguucugcggcaccagcggcaccuacggcaccggcagcuggcccgacggcgccaacaucaacuucaugcccaucuga

SEQ ID NO: 176118 - RNA, 1401 nt, Artificial Sequence
  derived and/or modified sequence opt4 from neuraminidase__InfluenzaA__AGQ81822
augaaccccaaccagaagaucaucgccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaagaaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcacccccggcgugaagggcugggccuucgacgacggcaacgacguguggaugggcagaaccaucagaaacgacagcagaagcggcuacgagaccuucagagugaucaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuacaugcccaucuga

SEQ ID NO: 176119 - RNA, 1401 nt, Artificial Sequence
  derived and/or modified sequence opt4 from neuraminidase__InfluenzaA__AGQ81823
augaaccccaaccagaagaucaucgccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucagaaacgacagcagaagcggcuacgagaccuucagaguggugaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176120 - RNA, 1401 nt, Artificial Sequence; identical to SEQ ID NO: 176119
  derived and/or modified sequence opt4 from neuraminidase__InfluenzaA__AGQ81824

SEQ ID NO: 176121 - RNA, 1401 nt, Artificial Sequence; identical to SEQ ID NO: 176119
  derived and/or modified sequence opt4 from neuraminidase__InfluenzaA__AGQ81825

SEQ ID NO: 176122 - RNA, 1401 nt, Artificial Sequence
  derived and/or modified sequence opt4 from neuraminidase__InfluenzaA__AGQ81831
augaaccccaaccagaagauccuggccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucgugaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcuucagcagcagcaacugcagagaccccaacaacgagagaggcgcccccggcgugaagggcugggccuucgacgacggcaacgacguguggaugggcagaaccaucagaaacgacagcagaagcggcuacgagaccuucagaguggugaacggcuggaccaccgccaacagcaagagccagaucaacagacaggugaucguggacagcgagagcuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176123 - RNA, 1401 nt, Artificial Sequence; identical to SEQ ID NO: 176112
  derived and/or modified sequence opt4 from neuraminidase__InfluenzaA__AGQ81837

SEQ ID NO: 176124 - RNA, 1401 nt, Artificial Sequence; identical to SEQ ID NO: 176112
  derived and/or modified sequence opt4 from neuraminidase__InfluenzaA__AGQ81838

SEQ ID NO: 176125 - RNA, 1401 nt, Artificial Sequence; identical to SEQ ID NO: 176119
  derived and/or modified sequence opt4 from neuraminidase__InfluenzaA__AGQ81839

SEQ ID NO: 176126 - RNA, 1401 nt, Artificial Sequence; identical to SEQ ID NO: 176119
  derived and/or modified sequence opt4 from neuraminidase__InfluenzaA__AGQ81840

SEQ ID NO: 176127 - RNA, 1401 nt, Artificial Sequence; identical to SEQ ID NO: 176112
  derived and/or modified sequence opt4 from neuraminidase__InfluenzaA__AGQ81841

SEQ ID NO: 176128 - RNA, 1410 nt, Artificial Sequence
  derived and/or modified sequence opt4 from neuraminidase__InfluenzaA__AGQ81843
augaaccccaaccagaagaucaucaccaucggcguggugaacaccacccugagcaccaucgcccugcugaucggcaucggcaaccugaucuucaacaccgugauccacgagaagaucggcgugcaccagaccgugguguaccccaccaucaccccccccgugauccccaacugcagcgacaccaccaucaccuacaacaacaccguggugaacaacaucaccaccaccaucaucaacaaggccgagaagcaguucaagcccagccugccccugugccccuucagaggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacgugugcaugaccggcaacgacaacgacgccagcggccagaucaucuacgccggcaagaugaccgacagcaucaagagcuggagaagagacauccugagaacccaggagagcgagugccagugcaucgacggcaccugcaucguggccgugaccgacggccccgccgccagcagcgccgaccacagaaucuacuggaucagagagggcaagaucaucaaguacgaggacauccccaagaccaagauccagcaccuggaggagugcagcugcuacguggacaccgacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacaucaacggcggccccggcgugaagggcuucggcuucagagccggcaacgacguguggcugggcagaaccgugagcaccaccggcagaagcggcuucgaggugaucaaggugaccgagggcuggaucaacagccugaaccacgccaagagcgugacccagacccuggugagcaacaacgacuggagcggcuacagcggcagcuucaucguggagaacaacggcugcuuccagcccugcuucuacaucgagcugaucagaggcagacccaacagaaacgacgacgugagcuggaccagcaacagcaucgugaccuucugcggccuggacaacgagcccggcagcggcaacuggcccgacggcagcaacaucggcuucaugcccaaguga

SEQ ID NO: 176129 - RNA, 1410 nt, Artificial Sequence
  derived and/or modified sequence opt4 from neuraminidase__InfluenzaA__AGQ81845
augaaccccaaccagaagaucaucaccaucggcguggugaacaccacccugagcaccaucgcccugcugaucggcaucggcaaccugaucuucaacaccgugauccacgagaagaucggcgugcaccagaccgugaucuaccccaccaucaccagccccguggugcccaacugcagcgacaccaccaucaccuacaacaacaccguggugaacaacaucaccaccaccgugaucaacaaggccgagaagcacuucaagcccagccugccccugugccccuucaagggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacgugugcaugaccggcaacgacaacgacgccagcggccagaucaucuacgccggcaagaugaccgacagcaucaagagcuggagaagagacauccugagaacccaggagagcgagugccagugcaucgacggcaccugcaucguggccgugaccgacggccccgccgccaacagcgccgaccacagaaucuacuggaucagagagggcaagaucaucaaguacgagaacauccccaagaccaagauccagcaccuggaggagugcagcugcuacguggacaccgacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacaucaacggcggccccggcgugaagggcuucggcuucagaaccggcaacgacguguggcugggcagaaccgugagcaccaccggcagaagcggcuucgaggugaucaaggugaccgagggcuggaucaacagccugaaccacgccaagagcgugacccagacccuggugagcaacagcgacuggagcggcuacagcggcagcuucaucguggagaacaacggcugcuuccagcccugcuucuacaucgagcugaucagaggcagacccaacaagaacgacgacgugagcuggaccagcaacagcaucgugaccuucugcggccuggacaacgagcccggcagcggcaacuggcccgacggcagcaacaucggcuucaugcccaaguga

SEQ ID NO: 176130 - RNA, 1410 nt, Artificial Sequence; identical to SEQ ID NO: 176129
  derived and/or modified sequence opt4 from neuraminidase__InfluenzaA__AGQ81846

SEQ ID NO: 176131 - RNA, 1410 nt, Artificial Sequence; identical to SEQ ID NO: 176129
  derived and/or modified sequence opt4 from neuraminidase__InfluenzaA__AGQ81847

SEQ ID NO: 176132 - RNA, 1410 nt, Artificial Sequence
  derived and/or modified sequence opt4 from neuraminidase__InfluenzaA__AGQ81848
augaaccccaaccagaagaucaucaccaucggcguggugaacaccacccugagcaccaucgcccugcugaucggcaucggcaaccugaucuucaacaccgugauccacgagaagaucggcgugcaccagaccgugaucuaccccaccaucaccagccccguggugcccaacugcagcgacaccaccaucaccuacaacaacaccguggugaacaacaucaccaccaccgugaucaacaaggccgagaagcacuucaagcccagccugccccugugccccuucaagggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacgugugcaugaccggcaacgacaacgacgccagcggccagaucaucuacgccggcaagaugaccgacagcaucaagagcuggagaagagacauccugagaacccaggagagcgagugccagugcaucgacggcaucugcaucguggccgugaccgacggccccgccgccaacagcgccgaccacagaaucuacuggaucagagagggcaagaucaucaaguacgagaacauccccaagaccaagauccagcaccuggaggagugcagcugcuacguggacaccgacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacaucaacggcggccccggcgugaagggcuucggcuucagaaccggcaacgacguguggcugggcagaaccgugagcaccaccggcagaagcggcuucgaggugaucaaggugaccgagggcuggaucaacagccugaaccacgccaagagcgugacccagacccuggugagcaacagcgacuggagcggcuacagcggcagcuucaucguggagaacaacggcugcuuccagcccugcuucuacaucgagcugaucagaggcagacccaacaagaacgacgacgugagcuggaccagcaacagcaucgugaccuucugcggccuggacaacgagcccggcagcggcaacuggcccgacggcagcaacaucggcuucaugcccaaguga

SEQ ID NO: 176133 - RNA, 1410 nt, Artificial Sequence
  derived and/or modified sequence opt4 from neuraminidase__InfluenzaA__AGQ81850
augaaccccaaccagaagaucaucaccaucggcguggugaacaccacccugagcaccaucgcccugcugaucggcaucggcaaccugaucuucaacaccgugauccacgagaagaucggcgugcaccagaccgugaucuaccccaccaucaccagccccguggugcccaacugcagcgacaccaccaucaccuacaacaacaccguggugaacaacaucaccaccaccgugaucaacaaggccgagaagcacuucaagcccagccugccccugugccccuucaagggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacgugugcaugaccggcaacgacaacgacgccaccggccagaucaucuacgccggcaagaugaccgacagcaucaagagcuggagaagagacauccugagaacccaggagagcgagugccagugcaucgacggcaccugcaucguggccgugaccgacggccccgccgccaacagcgccgaccacagaaucuacuggaucagagagggcaagaucaucaaguacgagaacauccccaagaccaagauccagcaccuggaggagugcagcugcuacguggacaccgacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacaucaacggcggccccggcgugaagggcuucggcuucagaaccggcaacgacguguggcugggcagaaccgugagcaccaccggcagaagcggcuucgaggugaucaaggugaccgagggcuggaucaacagccugaaccacgccaagagcgugacccagacccuggugagcaacagcgacuggagcggcuacagcggcagcuucaucguggagaacaacggcugcuuccagcccugcuucuacaucgagcugaucagaggcagacccaacaagaacgacgacgugagcuggaccagcaacagcaucgugaccuucugcggccuggacaacgagcccggcagcggcaacuggcccgacggcagcaacaucggcuucaugcccaaguga

SEQ ID NO: 176134 - RNA, 1410 nt, Artificial Sequence
  derived and/or modified sequence opt4 from neuraminidase__InfluenzaA__AGQ81852
augaaccccaaccagaagaucaucaccaucggcguggugaacaccacccugagcaccaucgcccugcugaucggcaucggcaaccugaucuucaacaccgugauccacgagaagaucggcgugcaccagaccgugaccuaccccaccaucaccagccccguggugcccaacugcagcgacaccaccaucaccuacaacaacaccguggugaacaacaucaccaccaccgugaucaacaaggccgagaagcacuucaagcccagccugccccugugccccuucaagggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacgugugcaugaccggcaacgacaacgacgccaccggccagaucaucuacgccggcaagaugaccgacagcaucaagagcuggagaagagacauccugagaacccaggagagcgagugccagugcaucgacggcaccugcaucguggccgugaccgacggccccgccgccaacagcgccgaccacagaaucuacuggaucagagagggcaagaucaucaaguacgagaacauccccaagaccaagauccagcaccuggaggagugcagcugcuacguggacaccgacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacaucaacggcggccccggcgugaagggcuucggcuucagaaccggcaacgacguguggcugggcagaaccgugagcaccaccggcagaagcggcuucgaggugaucaaggugaccgagggcuggaucaacagccugaaccacgccaagagcgugacccagacccuggugagcaacagcgacuggagcggcuacagcggcagcuucaucguggagaacaacggcugcuuccagcccugcuucuacaucgagcugaucagaggcagacccaacagaaacgacgacgugagcuggaccagcaacagcaucgugaccuucugcggccuggacaacgagcccggcagcggcaacuggcccgacggcagcaacaucggcuucaugcccaaguga

SEQ ID NO: 176135 - RNA, 1410 nt, Artificial Sequence
  derived and/or modified sequence opt4 from neuraminidase__InfluenzaA__AGQ81853
augaaccccaaccagaagaucaucaccaucggcguggugaacaccacccugagcaccaucgcccugcugaucggcaucggcaaccugaucuucaacaccgugauccacgagaagaucggcgugcaccagaccgugaccuaccccaccaucaccagccccguggugcccaacugcagcgacaccaccaucaccuacaacaacaccguggugaacaacaucaccaccaccgugaucaacaaggccgagaagcacuucaagcccagccugccccugugccccuucaagggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacgugugcaugaccggcaacgacaacgacgccaccggccagaucaucuacgccggcaagaugaccgacagcaucaagagcuggagaagagacauccugagaacccaggagagcgagugccagugcaucgacggcaccugcaucguggccgugaccgacggccccgccgccaacagcgccgaccacagaaucuacuggaucagagagggcaagaucaucaaguacgagaacauccccaagaccaagauccagcaccuggaggagugcagcugcuacguggacaccgacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacaucaacggcggccccggcgugaagggcuucggcuucagaaccggcaacgacguguggcugggcagaaccgugagcaccaccggcagaagcggcuucgaggugaucaaggugaccgagggcuggaucaacagccugaaccacgccaagagcgugacccagacccuggugagcaacagcgacuggagcggcuacagcggcagcuucaucguggagaacaacggcugcuuccagcccugcuucuacaucgagcugaucagaggcagacccaacaagaacgacgacgugagcuggaccagcaacagcaucgugaccuucugcggccuggacaacgagcccggcagcggcaacuggcccgacggcagcaacaucggcuucaugcccaaguga

SEQ ID NO: 176136 - RNA, 1410 nt, Artificial Sequence; identical to SEQ ID NO: 176135
  derived and/or modified sequence opt4 from neuraminidase__InfluenzaA__AGQ81854

SEQ ID NO: 176137 - RNA, 1410 nt, Artificial Sequence; identical to SEQ ID NO: 176135
  derived and/or modified sequence opt4 from neuraminidase__InfluenzaA__AGQ81855

SEQ ID NO: 176138 - RNA, 1410 nt, Artificial Sequence; identical to SEQ ID NO: 176128
  derived and/or modified sequence opt4 from neuraminidase__InfluenzaA__AGQ81856

SEQ ID NO: 176139 - RNA, 1410 nt, Artificial Sequence
  derived and/or modified sequence opt4 from neuraminidase__InfluenzaA__AGQ81857
augaaccccaaccagaagaucaucaccaucggcguggugaacaccacccugagcaccaucgcccugcugaucggcaucggcaaccugaucuucaacaccgugauccacgagaagaucggcgugcaccagaccgugguguaccccaccaucaccccccccgugauccccaacugcagcgacaccaccaucaccuacaacaacaccguggugaacaacaucaccaccaccaucaucaacaaggccgagaagcaguucaagcccagccugccccugugccccuucagaggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacgugugcaugaccggcaacgacaacgacgccagcggccagaucaucuacgccggcaagaugaccgacagcaucaagagcuggagaagagacauccugagaacccaggagagcgagugccagugcaucgacggcaccugcaucguggccgugaccgacggccccgccgccagcagcgccgaccacagaaucuacuggaucagagagggcaagaucaucaaguacgaggacauccccaagaccaagauccagcaccuggaggagugcagcugcuacguggacaccgacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacaucaacggcggccccggcgugaagggcuucggcuucagagccggcaacgacguguggcugggcagaaccgugagcaccaccggcagaagcggcuucgaggugaucaaggugaccgagggcuggaucaacagccugaaccacgccaagagcgugacccagacccuggugagcaacaacgacuggagcggcuacagcggcagcuucaucguggagagcaacggcugcuuccagcccugcuucuacaucgagcugaucagaggcagacccaacagaaacgacgacgugagcuggaccagcaacagcaucgugaccuucugcggccuggacaacgagcccggcagcggcaacuggcccgacggcagcaacaucggcuucaugcccaaguga

SEQ ID NO: 176140 - RNA, 1410 nt, Artificial Sequence
  derived and/or modified sequence opt4 from neuraminidase__InfluenzaA__AGQ81858
augaaccccaaccagaagaucaucaccaucggcguggugaacaccacccugagcaccaucgcccugcugaucggcgugggcaaccugaucuucaacaccgugauccacgagaagaucggcgaccaccagaucgugguguaccccaccaccaccgccagcguggugcccaacugcagcgacaccaucaucaccuacaacaacaccguggugaacaacaucaccaccaccaucaucaccaaggaggagacccacuucaagagcagccugccccugugccccuucagaggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacgugugcaugaccggcaacgacaacgacgccagcggccagaucauguacgccggcaagaugaccgacagcaucaagagcuggagaaaggacauccugagaacccaggagagcgagugccagugcaucgacggcaccugcaucguggccgugaccgacggccccgccaccaacagcgccgaccacagaaucuacuggaucagagagggcaagaucaucaaguacgagaacauccccaagaccaagauccagcaccuggaggagugcagcugcuacguggacaucgacguguacugcgugugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacgugaacggcggccccggcgugaagggcuucggcuucaagaccggcaacgacguguggcugggcagaaccgugagcaccagcggcagaagcggcuucgagaucaucaaggugaccgagggcuggaucaacagccccaaccacgccaagagcgugacccagacccuggugagcaacaacgacuggagcggcuacagcggcagcuucaucguggagaacaacggcugcuuccagcccugcuucuacaucgagcugaucagaggcagacccaacaagaacgacgacgugagcuggaccagcaacagcaucgugaccuucugcggccuggacaacgagcccggcagcggcaacuggcccgacggcagcaacaucggcuucaugcccaaguga

SEQ ID NO: 176141 - RNA, 1410 nt, Artificial Sequence
  derived and/or modified sequence opt4 from neuraminidase__InfluenzaA__AGQ81859
augaaccccaaccagaagaucaucaccaucggcguggugaacaccacccugagcaccaucgcccugcugaucggcaucggcaaccugaucuucaacaccgugauccacgagaagaucggcgugcaccagaccguggugugccccaccaucaccccccccguggugcccaacugcagcgacaccaccaucaccuacaacaacaccguggugaacaacaucaccaccaccaucaucaacaaggccgagaagcaguucaagagcagccugccccugugccccuucagaggcuucuuccccuuccacaaggacaacgccaucagacugggcgagaacaaggacgugaucgugaccagagagcccuacgugagcugcgacaacgacgacugcuggagcuucgcccuggcccagggcgcccugcugggcaccaagcacagcaacggcaccaucaaggacagaacccccuacagaagccugaucagauuccccaucggcaccgcccccgugcugggcaacuacaaggagaucugcguggccuggagcagcagcagcugcuucgacggcaaggaguggaugcacaucugcaugaccggcaacgacaacgacgccagcggccagaucaucuacgccggcaagaugaccgacagcaucaagagcuggagaagagacauccugagaacccaggagagcgagugccagugcaucgacggcaccugcaucguggccaucaccgacggccccgccgccagcagcgccgaccacagaaucuacuggaucagagagggcaagaucaucaaguacgagaacauccccaagaccaagauccagcaccuggaggagugcagcugcuacguggacaucgacguguacugcaucugcagagacaacuggaagggcagcaacagacccuggaugagaaucaacaacgagaccauccuggagaccggcuacgugugcagcaaguuccacagcgacacccccagacccgccgaccccagcaccgugagcugcgacagccccagcaacaucaacggcggccccggcgugaagggcuucggcuucagagccggcaacgacguguggcugggcagaaccgugagcaccaccggcagaagcggcuucgaggugaucaaggugaccgagggcuggaucaacagccugaaccacgccaagagcgugacccagacccuggugagcaacagcgacuggagcggcuacagcggcagcuucaucguggagaacaacggcugcuuccagcccugcuucuacaucgagcugaucagaggcagacccaacagaaacgacgacgugagcuggaccagcaacagcaucgugaccuucugcggccuggacaacgagcccggcagcggcaacuggcccgacggcagcaacaucggcuucaugcccaaguga

SEQ ID NO: 176142 - RNA, 1413 nt, Artificial Sequence
  derived and/or modified sequence opt4 from neuraminidase__InfluenzaA__AGQ81860
augaaccccaaccagaagaucaucugcaucagcgccaccggcaugacccugagcguggugagccugcugaucggcaucgccaaccugggccugaacaucggccugcacuacaaggugggcgacacccccgacgugagcauccccaacaugaacgagaccaacagcaccaccaccaucaucaacaacaacacccagaacaacuucaccaacaucaccaacaucaucgugaacaagaacgaggagaagaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccuggugagcugggagaugggccaggcccccagccccuacaacgugaagguggagugcgugggcuggagcagcaccagcugccacgacggcaucagcagaaugagcaucugcaugagcggccccaacaacaacgccagcgccguggugugguacggcggcagacccgugaccgagauccccagcugggccggcaacauccugagaacccaggagagcgagugcgugugccacaagggcaucugccccguggugaugaccgacggccccgccaacaacagagccgccaccaagaucaucuacuucaaggagggcaagauccagaagaucgaggagcuggccggcagcgcccagcacaucgaggagugcagcugcuacggcgccguggaggugaucaagugcaucugcagagacaacuggaagggcgccaacagacccgugaucaccaucaaccccgagaugaugacccacaccagcaaguaccugugcagcaaggugcugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagccaccaggugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcaaggagagacugggcagcuggagcuggcacgacggcgccgagaucaucuacuucaaguga

SEQ ID NO: 176143 - RNA, 1413 nt, Artificial Sequence
  derived and/or modified sequence opt4 from neuraminidase__InfluenzaA__AGQ81861
augaaccccaaccagaagaucaucugcaucagcgccaccggcaugacccugagcguggugagccugcugaucggcaucgccaaccugggccugaacaucggccugcacuacaaggugggcgacacccccgacgugagcauccccaacaugaacgagaccaacagcaccaccaccaucaucaacaacaacacccagaacaacuucaccaacaccaccaacaucaucgugaacaagaacgaggagaagaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccuggugagcugggagaugggccaggcccccagccccuacaacgugaagguggagugcgugggcuggagcagcaccagcugccacgacggcaucagcagaaugagcaucugcaugagcggccccaacaacaacgccagcgccguggugugguacggcggcagacccgugaccgagauccccagcugggccggcaacauccugagaacccaggagagcgagugcgugugccacaagggcaucugccccguggugaugaccgacggccccgccaacaacagagccgccaccaagaucaucuacuucaaggagggcaagauccagaagaucgaggagcuggccggcagcgcccagcacaucgaggagugcagcugcuacggcgccguggaggugaucaagugcaucugcagagacaacuggaagggcgccaacagacccgugaucaccaucaaccccgagaugaugacccacaccagcaaguaccugugcagcaaggugcugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagccaccaggugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcaaggagagacugggcagcuggagcuggcacgacggcgccgagaucaucuacuucaaguga

SEQ ID NO: 176144 - RNA, 1413 nt, Artificial Sequence
  derived and/or modified sequence opt4 from neuraminidase__InfluenzaA__AGQ81862
augaaccccaaccagaagaucaucugcaucagcgccaccggcaugacccugagcguggugagccugcugaucggcaucgccaaccugggccugaacaucggccugcacuacaaggugggcgacacccccgacgugaacauccccagcaugaacgagaccaacagcaccaccaccaucaucaacaacaacacccagaacaacuucaccaacaucaccaacaucaucgugaacaaggaggagggcagaaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccuggugagcugggagaugggccaggcccccagccccuacaacgugagaguggagugcaucggcuggagcagcaccagcugccacgacggcaucagcagaaugagcaucugcaugagcggccccaacaacaacgccagcgccguggugugguacggcggcagacccgugaccgagauccccagcugggccggcaacauccugagaacccaggagagcgagugcgugugccacaagggcaucugccccguggugaugaccgacggccccgccaacaacagagccgccaccaagaucaucuacuucaaggagggcaagauccagaagaucgaggagcuggagggcaacgcccagcacaucgaggagugcagcugcuacggcgccgccggcgugaucaagugcaucugcagagacaacuggaagggcgccaacagacccgugaucaucaucgaccccgagaugaugacccacaccagcaaguaccugugcagcagagugcugaccgacaccagcagacccaacgaccccaccagcggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagccaccaggugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcaaggagagacugggcagcuggagcuggcacgacggcgccgagaucaucuacuucaaguga

SEQ ID NO: 176145 - RNA, 1413 nt, Artificial Sequence
  derived and/or modified sequence opt4 from neuraminidase__InfluenzaA__AGQ81863
augaaccccaaccagaagaucaucugcaucagcgccaccggcaugacccugagcguggugagccugcugaucggcaucgccaaccugggccugaacaucggccugcacuacaaggugggcgacacccccgacgugaacauccccagcaugaacgagaccaacagcaccaccaccaucaucaacaacaacacccagaacaacuucaccaacaucaccaacaucaucgugaacaaggaggaggagagaaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccuggugagcugggagaugggccaggcccccagccccuacaacgugagaguggagugcaucggcuggagcagcaccagcugccacgacggcaucagcagaaugagcaucugcaugagcggccccaacaacaacgccagcgccguggugugguacggcggcagacccgugaccgagauccccagcugggccggcaacauccugagaacccaggagagcgagugcgugugccacaagggcaucugccccguggugaugaccgacggccccgccaacaacagagccgccaccaagaucaucuacuucaaggagggcaagauccagaagaucgaggagcuggagggcaacgcccagcacaucgaggagugcagcugcuacggcgccgccggcgugaucaagugcaucugcagagacaacuggaagggcgccaacagacccgugaucaucaucgaccccgagaugaugacccacaccagcaaguaccugugcagcagagugcugaccgacaccagcagacccaacgaccccaucagcggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagccaccaggugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcaaggagagacugggcagcuggagcuggcacgacggcgccgagaucaucuacuucaaguga

SEQ ID NO: 176146 - RNA, 1416 nt, Artificial Sequence
  derived and/or modified sequence opt4 from neuraminidase__InfluenzaA__AGQ81864
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaccaccaucaaccagaacaacaccaccaucguggagaacaccuacgugaacaacaccaccaucaucagcaaggagaccgagcugaagccccccaacuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggccuacaccaaggugauguacuuccacaagggccuggugaucaaggaggaggcccugaagggcagcgccagacacaucgaggagugcagcugcuacggccacagccagaaggccaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccaagagcagaagcggcuucgagaugcugaagauccccaacgccggcaccgaccccaacagcagaaucgccgagagacaggagaucguggacaacaacaacuggagcggcuacagcggcagcuucaucgacuacugggacaacgacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176147 - RNA, 1416 nt, Artificial Sequence
  derived and/or modified sequence opt4 from neuraminidase__InfluenzaA__AGQ81865
augaaccccaaccagaagcuguucgcccugagcggcguggccaucgcccugagcgugcugaaccugcugaucggccugagcaacgugggccugaacgugagccugcaccugaaggagaccggccccaagcaggagggcaaccugaccugcaugaccaucaaccagaacaacaccaccgugguggagaacaccuacgugaacaacaccaccaucaucaccaaggagaccgagagcgagacccccaacuaccugcugcugaacaagagccugugcaacguggagggcuggguggugaucgccaaggacaacgccgugagauucggcgagagcgagcagaucaucgugaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccugguggugaaggaggaggcccugaagggcagcgccagacacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcggcaacaccuggcugggcagaaccaucagccccagaagcagaagcggcuucgagaugcugaagauccccaacgccggcaccgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176148 - RNA, 1416 nt, Artificial Sequence
  derived and/or modified sequence opt4 from neuraminidase__InfluenzaA__AGQ81868
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaccaccaucaaccagaacaacaccaccgugguggagaacaccuacgugaacaacaccaccaucaucaccaaggagaccgagcugaagacccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccagccugggcaccccccccaccaucagcaacagcgacuucaugugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaucugcgccguggugaugaccgacggcagcgccagcagccaggccuacaccaaggugauguacuuccacaagggccugguggugaaggaggaggcccugaagggcagcgccagacacaucgaggagugcagcugcuacggccacagccagaaggugaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucgccggcagccccggcgcccccggcgugaagggcuucggcuuccugaacggcgacaacaccuggcugggcagaaccaucagccccagaagcagaagcggcuucgagaugcugaagauccccaacgccggcaccgaccccaacagcagaaucgccggcagacaggagaucguggacaacaacaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176149 - RNA, 1416 nt, Artificial Sequence
  derived and/or modified sequence opt4 from neuraminidase__InfluenzaA__AGQ81869
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaccaccaucaaccagaacaacaccaccaucguggagaacaccuacgugaacaacaccaccaucaucagcaaggagaccgagcugaagacccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucagaaccugggccagaaacauccugagaacccaggagagcgagugcgugugccacaacggcaccugcgccguggugaugaccgacggcagcgccagcagccaggccuacaccaaggugauguacuuccacaagggccuggugaucaaggaggaggcccugaagggcagcgccagacacaucgaggagugcagcugcuacggccacagccagaaggccaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaccgaccccaacagcagaaucgccgagagacaggagaucguggacaacaacaacuggagcggcuacagcggcagcuucaucgacuacuggaacaacgacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176150 - RNA, 1416 nt, Artificial Sequence
  derived and/or modified sequence opt4 from neuraminidase__InfluenzaA__AGQ81870
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaccaccaucaaccagaacaacaccaccaucguggagaacaccuacgugaacaacaccaccaucaucagcaaggagaccgagcugaagccccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucagaaccugggccagaaacauccugagaacccaggagagcgagugcgugugccacaacggcaccugcgccguggugaugaccgacggcagcgccagcagccaggccuacaccaaggugauguacuuccacaagggccuggugaucaaggaggaggcccugaagggcagcgccagacacaucgaggagugcagcugcuacggccacagccagaaggccaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaccgaccccaacagcagaaucgccgagagacaggagaucguggacaacaacaacuggagcggcuacagcggcagcuucaucgacuacuggaacaacgacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176151 - RNA, 1416 nt, Artificial Sequence
  derived and/or modified sequence opt4 from neuraminidase__InfluenzaA__AGQ81871
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaccaccaucaaccagaacaacaccaccaucguggagaacaccuacgugaacaacaccaccaucaucagcaaggagaccgagcugaagacccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcaucggcuggagcagcaccaccugccacgacggcaucggcagaaugaccaucugcauccagggcaacaacgacaacgccaccgccaccguguacuacaacagaagacugaccaccaccaucagaaccugggccagaaacauccugagaacccaggagagcgagugcgugugccacaacggcaccugcgccguggugaugaccgacggcagcgccagcagccaggccuacaccaaggugauguacuuccacaagggccuggugaucaaggaggaggcccugaagggcagcgccagacacaucgaggagugcagcugcuacggccacagccagaaggccaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaccgaccccaacagcagaaucgccgagagacaggagaucguggacaacaacaacuggagcggcuacagcggcagcuucaucgacuacuggaacaacgacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176152 - RNA, 1416 nt, Artificial Sequence
  derived and/or modified sequence opt4 from neuraminidase__InfluenzaA__AGQ81872
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaccaccaucaaccagaacaacaccaccaucguggagaacaccuacgugaacaacaccaccaucaucagcaaggagaccgagcugaagacccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccagcgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucagaaccugggccagaaacauccugagaacccaggagagcgagugcgugugccacaacggcaccugcgccguggugaugaccgacggcagcgccagcagccaggccuacaccaaggugauguacuuccacaagggccuggugaucaaggaggaggcccugaagggcagcgccagacacaucgaggagugcagcugcuacggccacagccagaaggccaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaccgaccccaacagcagaaucgccgagagacaggagaucguggacaacaacaacuggagcggcuacagcggcagcuucaucgacuacuggaacaacgacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176153 - RNA, 1416 nt, Artificial Sequence
  derived and/or modified sequence opt4 from neuraminidase__InfluenzaA__AGQ81875
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaugaccaucaaccagaacaacaccaccgugguggagaacaccuacgugaacaacaccaccaucaucaccaaggagaccgagcuggagacccccagcuaccugcugcugaacaagggccugugcaacguggagggcuggguggugaucgccaaggacaacgccgugagauucggcgagaccgagcagaucaucgugaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugaucuacuuccacaagggccugaucgugaaggaggaggcccugaagggcagcgccagacacaucgaggagugcagcugcuacggccacagccagaaggugaccugcgugugcagagacaacuggcagggcgccaacagacccaucaucgagaucgacaugaacacccuggagcacaccagcagauacgugugcaccggcauccugaccgacaccagcagacccggcgacaagagcaccggcgacugcagcaaccccaucaccggcagccccggcgcccccggcgugaagggcuucggcuaccugaacggcgacaacaccuggcugggcagaaccaucagccccagaagcagaagcggcuucgagaugcugaagauccccaacgccggcaccgaccccaacagcagaaucaccgagagacaggagaucguggacaacaacaacuggagcggcuacagcggcagcuucguggacuacuggaacgacaacagcgagugcuacaaccccugcuucuacguggagcugaucagaggcagacccgaggaggccaaguacgugugguggaccagcaacagcaucaucgcccugugcggcagccccuuccccgugggcagcggcagcuuccccgacggcgcccagauccaguacuucagcuga

SEQ ID NO: 176154 - RNA, 1416 nt, Artificial Sequence
  derived and/or modified sequence opt4 from neuraminidase__InfluenzaA__AGQ81876
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaugaccaucaaccagaacaacaccaccgugguggagaacaccuacgugaacaacaccaccaucaucaccaaggagaccgagcuggagacccccagcuaccugcugcugaacaagggccugugcaacguggagggcuggguggugaucgccaaggacaacgccgugagauucggcgagaccgagcagaucaucgugaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcgacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugaucuacuuccacaagggccugaucgugaaggaggaggcccugaagggcagcgccagacacaucgaggagugcagcugcuacggccacagccagaaggugaccugcgugugcagagacaacuggcagggcgccaacagacccaucaucgagaucgacaugaacacccuggagcacaccagcagauacgugugcaccggcauccugaccgacaccagcagacccggcgacaagagcaccggcgacugcagcaaccccaucaccggcagccccggcgcccccggcgugaagggcuucggcuaccugaacggcgacaacaccuggcugggcagaaccaucagccccagaagcagaagcggcuucgagaugcugaagauccccaacgccggcaccgaccccaacagcagaaucaccgagagacaggagaucguggacaacaacaacuggagcggcuacagcggcagcuucguggacuacuggaacgacaacagcgagugcuacaaccccugcuucuacguggagcugaucagaggcagacccgaggaggccaaguacgugugguggaccagcaacagcaucaucgcccugugcggcagccccuuccccgugggcagcggcagcuuccccgacggcgcccagauccaguacuucagcuga

SEQ ID NO: 176155 - RNA, 1416 nt, Artificial Sequence
  derived and/or modified sequence opt4 from neuraminidase__InfluenzaA__AGQ81877
augaaccccaaccagaagcuguucgcccugagcggcguggccaucgcccugagcgugcugaaccugcugaucggcaucagcaacgugggccugaacgugagccugcaccugaaggagaagggccccaagcaggaggagaacagcaccugcaccaccaucaaccagaacaacaccaccgugguggagaacaccuacgugaacaacaccaccaucaucaccaaggagaccgagcugaagacccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccagccugggcaccccccccaccaucagcaacagcgacuucaugugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaucugcgccguggugaugaccgacggcagcgccagcagccaggccuacaccaaggugauguacuuccacaagggccugguggugaaggaggaggcccugaagggcagcgccagacacaucgaggagugcagcugcuacggccacagccagaaggugaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaccgaccccaacagcagaaucgccggcagacaggagaucguggacaacaacaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176156 - RNA, 1416 nt, Artificial Sequence
  derived and/or modified sequence opt4 from neuraminidase__InfluenzaA__AGQ81878
augaaccccaaccagaagcuguucgcccugagcggcguggccaucgcccugagcgugcugaaccugcugaucggcaucagcaacgugggccugaacgugagccugcaccugaaggagaagggccccaagcaggaggagaaccugaccugcaccaccaucaaccagaacaacaccaccgugguggagaacaccuacgugaacaacaccaccaucaucaccaaggagaccgaccugaaggcccccagcuaccugcugcugaacaagagccugugcaacguggagggcuggguggugaucgccaaggacaacgccgugagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaugugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggccuacaccaaggugauguacuuccacaagggccugguggugaaggaggaggcccugaagggcagcgccagacacaucgaggagugcagcugcuacggccacagccagaaggugaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaccgaccccaacagcagaaucgccgagagacaggagaucguggacaacaacaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccaucggcagcggcagcuuccccgacggcgcccagauccaguacuucagcuga

SEQ ID NO: 176157 - RNA, 1416 nt, Artificial Sequence
  derived and/or modified sequence opt4 from neuraminidase__InfluenzaA__AGQ81882
augaaccccaaccagaagcuguucgcccugagcggcguggccaucgcccugagcgugcugaaccugcugaucggcaucagcaacgugggccugaacgugagccugcaccugaaggagaagggcgccaagcaggaggagaaccugaccugcaccaccaucaaccagaacaacaccaccgugguggagaacaccuacgugaacaacaccaccgugaucaccaaggaggccgacuggaagacccccagcuaccugcugcugaacaagagccugugcaacguggagggcuggguggugaucgccaaggacaacgccaucagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaugugcgugggcuggagcagcaccaccugccacgacggcaucggcagaaugaccaucugcauccagggcaacaacgacaacgccaccgccaccguguacuacaacggcagacugaccaccaccaucaagaccugggccagaaacauccugagaacccaggagagcgagugcgugugccacaacggcaccugcgccguggugaugaccgacggcagcgccagcagccaggccuacaccaaggugauguacuuccacaagggccuggugaucaaggaggaggcccugaagggcagcgccagacacaucgaggagugcagcugcuacggccacagccagaaggugaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacaacaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176158 - RNA, 1416 nt, Artificial Sequence
  derived and/or modified sequence opt4 from neuraminidase__InfluenzaA__AGQ81883
augaaccccaaccagaagcuguucgcccugagcggcguggccaucgcccugagcgugcugaaccugcugaucggcaucagcaacgugggccugaacgugagccugcaccugaaggagaagggccccaagcaggaggagaaccugaccugcaccaccaucaaccagaacaacaccaccgugguggagaacaccuacgugaacaacaccaccgugaucaccaaggaggccgacuggaagacccccagcuaccugcugcugaacaagagccugugcaacguggagggcuggguggugaucgccaaggacaacgccaucagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaugugcgugggcuggagcagcaccaccugccacgacggcaucggcagaaugaccaucugcauccagggcaacaacgacaacgccaccgccaccguguacuacaacggcagacugaccaccaccaucaagaccugggccagaaacauccugagaacccaggagagcgagugcgugugccacaacggcaccugcgccguggugaugaccgacggcagcgccagcagccaggccuacaccaaggugauguacuuccacaagggccuggugaucaaggaggaggcccugaagggcagcgccagacacaucgaggagugcagcugcuacggccacagccagaaggugaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacaacaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176159 - RNA, 1416 nt, Artificial Sequence; identical to SEQ ID NO: 176158
  derived and/or modified sequence opt4 from neuraminidase__InfluenzaA__AGQ81884

SEQ ID NO: 176160 - RNA, 1416 nt, Artificial Sequence; identical to SEQ ID NO: 176158
  derived and/or modified sequence opt4 from neuraminidase__InfluenzaA__AGQ81885

SEQ ID NO: 176161 - RNA, 1416 nt, Artificial Sequence; identical to SEQ ID NO: 176158
  derived and/or modified sequence opt4 from neuraminidase__InfluenzaA__AGQ81886

SEQ ID NO: 176162 - RNA, 1356 nt, Artificial Sequence
  derived and/or modified sequence opt4 from neuraminidase__InfluenzaA__AGQ81888
augaaccccaaccagaagcuguucgcccugagcggcguggccaucgcccugagcgugcugaaccugcugaucggccugagcaacgugggccugaacgugagccugcaccugaaggaggccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176163 - RNA, 1356 nt, Artificial Sequence
  derived and/or modified sequence opt4 from neuraminidase__InfluenzaA__AGQ81889
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176164 - RNA, 1356 nt, Artificial Sequence; identical to SEQ ID NO: 176163
  derived and/or modified sequence opt4 from neuraminidase__InfluenzaA__AGQ81890

SEQ ID NO: 176165 - RNA, 1356 nt, Artificial Sequence; identical to SEQ ID NO: 176163
  derived and/or modified sequence opt4 from neuraminidase__InfluenzaA__AGQ81891

SEQ ID NO: 176166 - RNA, 1356 nt, Artificial Sequence
  derived and/or modified sequence opt4 from neuraminidase__InfluenzaA__AGQ81893
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccgaguacgugugguggaccagcaacagccugaucgcccugugcggcagccccuuccccgugggcagcggcagcuuccccgacggcgcccagauccaguacuucagcuga

SEQ ID NO: 176167 - RNA, 1356 nt, Artificial Sequence; identical to SEQ ID NO: 176163
  derived and/or modified sequence opt4 from neuraminidase__InfluenzaA__AGQ81894

SEQ ID NO: 176168 - RNA, 1356 nt, Artificial Sequence; identical to SEQ ID NO: 176163
  derived and/or modified sequence opt4 from neuraminidase__InfluenzaA__AGQ81895

SEQ ID NO: 176169 - RNA, 1356 nt, Artificial Sequence; identical to SEQ ID NO: 176163
  derived and/or modified sequence opt4 from neuraminidase__InfluenzaA__AGQ81896

SEQ ID NO: 176170 - RNA, 1356 nt, Artificial Sequence; identical to SEQ ID NO: 176163
  derived and/or modified sequence opt4 from neuraminidase__InfluenzaA__AGQ81897

SEQ ID NO: 176171 - RNA, 1356 nt, Artificial Sequence; identical to SEQ ID NO: 176163
  derived and/or modified sequence opt4 from neuraminidase__InfluenzaA__AGQ81898

SEQ ID NO: 176172 - RNA, 1356 nt, Artificial Sequence; identical to SEQ ID NO: 176163
  derived and/or modified sequence opt4 from neuraminidase__InfluenzaA__AGQ81899

SEQ ID NO: 176173 - RNA, 1356 nt, Artificial Sequence; identical to SEQ ID NO: 176163
  derived and/or modified sequence opt4 from neuraminidase__InfluenzaA__AGQ81900

SEQ ID NO: 176174 - RNA, 1356 nt, Artificial Sequence; identical to SEQ ID NO: 176163
  derived and/or modified sequence opt4 from neuraminidase__InfluenzaA__AGQ81901

SEQ ID NO: 176175 - RNA, 1356 nt, Artificial Sequence; identical to SEQ ID NO: 176163
  derived and/or modified sequence opt4 from neuraminidase__InfluenzaA__AGQ81902

SEQ ID NO: 176176 - RNA, 1356 nt, Artificial Sequence; identical to SEQ ID NO: 176163
  derived and/or modified sequence opt4 from neuraminidase__InfluenzaA__AGQ81903

SEQ ID NO: 176177 - RNA, 1356 nt, Artificial Sequence
  derived and/or modified sequence opt4 from neuraminidase__InfluenzaA__AGQ81904
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucaccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176178 - RNA, 1356 nt, Artificial Sequence; identical to SEQ ID NO: 176163
  derived and/or modified sequence opt4 from neuraminidase__InfluenzaA__AGQ81905

SEQ ID NO: 176179 - RNA, 1356 nt, Artificial Sequence
  derived and/or modified sequence opt4 from neuraminidase__InfluenzaA__AGQ81906
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccugguggugaaggaggaggcccugaagggcagcgccagacacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176180 - RNA, 1356 nt, Artificial Sequence; identical to SEQ ID NO: 176163
  derived and/or modified sequence opt4 from neuraminidase__InfluenzaA__AGQ81907

SEQ ID NO: 176181 - RNA, 1356 nt, Artificial Sequence
  derived and/or modified sequence opt4 from neuraminidase__InfluenzaA__AGQ81908
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcaaccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucaccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176182 - RNA, 1356 nt, Artificial Sequence; identical to SEQ ID NO: 176163
  derived and/or modified sequence opt4 from neuraminidase__InfluenzaA__AGQ81909

SEQ ID NO: 176183 - RNA, 1356 nt, Artificial Sequence
  derived and/or modified sequence opt4 from neuraminidase__InfluenzaA__AGQ81910
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcggccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagcuacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176184 - RNA, 1356 nt, Artificial Sequence
  derived and/or modified sequence opt4 from neuraminidase__InfluenzaA__AGQ81911
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcggccaggcccacaccaaggugauguacuuccacaagggccugguggugaaggaggaggcccugaagggcagcgccaagcacaucgaggagugcagcugcuacggccacaaccagaacgugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176185 - RNA, 1356 nt, Artificial Sequence; identical to SEQ ID NO: 176163
  derived and/or modified sequence opt4 from neuraminidase__InfluenzaA__AGQ81912

SEQ ID NO: 176186 - RNA, 1356 nt, Artificial Sequence
  derived and/or modified sequence opt4 from neuraminidase__InfluenzaA__AGQ81913
augaaccccaaccagaagcuguucgcccugagcggcguggccaucacccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcggccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176187 - RNA, 1356 nt, Artificial Sequence; identical to SEQ ID NO: 176163
  derived and/or modified sequence opt4 from neuraminidase__InfluenzaA__AGQ81914

SEQ ID NO: 176188 - RNA, 1356 nt, Artificial Sequence; identical to SEQ ID NO: 176163
  derived and/or modified sequence opt4 from neuraminidase__InfluenzaA__AGQ81915

SEQ ID NO: 176189 - RNA, 1416 nt, Artificial Sequence
  derived and/or modified sequence opt4 from neuraminidase__InfluenzaA__AGQ81917
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaucaaccagaacaacaccaccgugguggagaacaccuacgugaacaacaccaccaucaucaccaaggagaccgagcuggagacccccaacuaccugcugcugaacaagagccugugcaacguggagggcuggguggugguggccaaggacaacgccgugagauucggcgagagcgagcagaucaucgugaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccuggugaucaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176190 - RNA, 1356 nt, Artificial Sequence
  derived and/or modified sequence opt4 from neuraminidase__InfluenzaA__AGQ81918
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagggccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176191 - RNA, 1356 nt, Artificial Sequence; identical to SEQ ID NO: 176163
  derived and/or modified sequence opt4 from neuraminidase__InfluenzaA__AGQ81919

SEQ ID NO: 176192 - RNA, 1356 nt, Artificial Sequence; identical to SEQ ID NO: 176163
  derived and/or modified sequence opt4 from neuraminidase__InfluenzaA__AGQ81920

SEQ ID NO: 176193 - RNA, 1356 nt, Artificial Sequence
  derived and/or modified sequence opt4 from neuraminidase__InfluenzaA__AGQ81921
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcggccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176194 - RNA, 1356 nt, Artificial Sequence; identical to SEQ ID NO: 176163
  derived and/or modified sequence opt4 from neuraminidase__InfluenzaA__AGQ81922

SEQ ID NO: 176195 - RNA, 1356 nt, Artificial Sequence; identical to SEQ ID NO: 176193
  derived and/or modified sequence opt4 from neuraminidase__InfluenzaA__AGQ81923

SEQ ID NO: 176196 - RNA, 1356 nt, Artificial Sequence
  derived and/or modified sequence opt4 from neuraminidase__InfluenzaA__AGQ81924
augaaccccaaccagaagcuguucgcccugagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccaacagccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176197 - RNA, 1356 nt, Artificial Sequence; identical to SEQ ID NO: 176163
  derived and/or modified sequence opt4 from neuraminidase__InfluenzaA__AGQ81925

SEQ ID NO: 176198 - RNA, 1356 nt, Artificial Sequence; identical to SEQ ID NO: 176163
  derived and/or modified sequence opt4 from neuraminidase__InfluenzaA__AGQ81926

SEQ ID NO: 176199 - RNA, 1356 nt, Artificial Sequence; identical to SEQ ID NO: 176163
  derived and/or modified sequence opt4 from neuraminidase__InfluenzaA__AGQ81927

SEQ ID NO: 176200 - RNA, 1356 nt, Artificial Sequence; identical to SEQ ID NO: 176163
  derived and/or modified sequence opt4 from neuraminidase__InfluenzaA__AGQ81928

SEQ ID NO: 176201 - RNA, 1356 nt, Artificial Sequence; identical to SEQ ID NO: 176163
  derived and/or modified sequence opt4 from neuraminidase__InfluenzaA__AGQ81929

SEQ ID NO: 176202 - RNA, 1413 nt, Artificial Sequence
  derived and/or modified sequence opt4 from neuraminidase__InfluenzaA__AGQ81930
augaaccccaaccagaagaucaucaccaucggcagcaucagccugggccuggugguguucaacgugcugcugcacguggugagcaucaucgugaccgugcuggugcugggcagaggcggcaacagcggcaucugcaacgagaccguggugagagaguacaacgagaccgugagaaucgagaagaucacccaguggcacaacaccagcgugguggaguacgugcccuacuggagcgagggcaacuacaugaacaacaccgaggccaucugcgacgugaagggcuucgcccccuucagcaaggacaacggcaucagaaucggcagcagaggccacguguucgugaucagagagcccuucgugagcugcagccccaccgagugcagaaccuucuuccugacccagggcagccugcugaacgacaagcacagcaacggcaccgugaaggacagaagccccuucagaacccugaugagcguggaggugggccagagccccaacguguaccaggccagauucgaggccguggccuggagcgccaccgccugccacgacggcaagaaguggaugaccaucggcgugaccggccccgacagcaaggccguggccguggugcacuacggcggcgugcccaccgacguggugaacagcugggccggcgacauccugagaacccaggagagcagcugcaccugcauccagggcaacugcuacugggugaugaccgacggccccgccaacagacaggcccaguacagaaucuacaaggccaaccagggcaagaucgugggccagaccgacaucagcuucaacggcggccacaucgaggagugcagcugcuaccccaacgacggcaagguggagugcgugugcagagacaacuggaccggcaccaacagacccgugcuggugaucagccccgaccugagcuacagagugggcuaccugugcgccggccugcccagcgacacccccagaggcgaggacgcccaguucaccggcagcugcaccagccccaugggcaaccagggcuacggcgugaagggcuucggcuucagacagggcaccgacguguggaugggcagaaccaucagcagaaccagcagaagcggcuucgagauccugagaaucaagaacggcuggacccagaccagcaaggagcaggugagaaagcagguggugguggacaaccugaacuggagcggcuacagcggcagcuucacccugcccguggagcugagcggcaaggacugccuggugcccugcuucuggguggagaugaucagaggcaagcccgaggagaagaccaucuggaccagcagcagcagcaucgugaugugcggcguggacuacgagguggccgacuggagcuggcacgacggcgccauccugcccuucgacaucgacaagauguga

SEQ ID NO: 176203 - RNA, 1413 nt, Artificial Sequence
  derived and/or modified sequence opt4 from neuraminidase__InfluenzaA__AGQ81931
augaaccccaaccagaagaucaucaccaucggcagccugagccugggccugguggugcugaacauccugcugcacaucaucagcaucaccaucaccgugcuggugauccccagaaacggcaacaccggcagcugcaacgagaccgugaucagagaguacaacgagaccgugagaaucgagaagaucacccaguggcacaacaccaacaucaucgaguacaucgagaagcccgagaacgaccuguucaugaacaacaccggcccccugugcgacgccaagggcuucgcccccuucagcaaggacaacggcaucagaaucggcagcaagggccacguguucgugaucagagagcccuucgugagcugcagccccaccgagugcagaaccuucuuccugacccagggcagccugcugaacgacaagcacagcaacggcaccgugaaggacagaagccccuacagaacccugaugagcguggagaucggccagagccccaacguguaccaggccagauucgaggccguggccuggagcgccaccgccugccacgacggcaagaaguggaugaccaucggcgugaccggccccgacgccaaggccguggccguggugcacuacggcggcauccccaccgacgugaucaacagcugggccggcgacauccugagaacccaggagagcagcugcaccugcauccagggcgagugcuacugggugaugaccgacggccccgccaacagacaggcccaguacagagccuucaaggccaagcagggcaagaucaucggccagaccgagaucagcuucaacggcggccacaucgaggagugcagcugcuaccccaacgagggcaagguggagugcgugugcagagacaacuggaccggcaccaacagacccgugcuggugaucagcagcgaccugagcuacagagugggcuaccugugcgccggccugcccagcgacacccccagaggcgaggacagccaguucaccggcagcugcaccagccccaugggcaaccagggcuacggcgugaagggcuucggcuucagacagggcaacgacguguggaugggcagaaccaucagcagaaccagcagaagcggcuucgagauccugaagaucagaaacggcuggauccagaacagcaaggagcagaucaagagacagguggugguggacaacagcaacuggagcggcuacagcggcagcuucacccugcccguggagcugaccagaagaaacugccuggugcccugcuucuggguggagaugaucagaggcaagcccgaggagaagaccaucuggaccagcagcagcagcaucgugaugugcggcguggaccacgagaucgccaacuggagcuggcacgacggcgccauccugcccuucgacaucgacaagauguga

SEQ ID NO: 176204 - RNA, 1413 nt, Artificial Sequence
  derived and/or modified sequence opt4 from neuraminidase__InfluenzaA__AGQ81932
augaaccccaaccagaagaucaucaccaucggcagcaucagccugggccuggugguguucaacgugcugcugcacguggugagcaucaucgugaccgugcugauccugggcagaggcggcaacaacggcaucugcaacgagaccguggugagagaguacaacgagaccgugagaaucgagaagaucacccaguggcacaacaccagcgugguggaguacgugcccuacuggaacgagggcaccuacaugaacaacaccgaggccaucugcgacgugaagggcuucgcccccuucagcaaggacaacggcaucagaaucggcagcagaggccacguguucgugaucagagagcccuucgugagcugcagccccaccgagugcagaaccuucuuccugacccagggcagccugcugaacgacaagcacagcaacggcaccgugaaggacagaagccccuucagaacccugaugagcguggaggugggccagagccccaacguguaccaggccagauucgaggccguggccuggagcgccaccgccugccacgacggcaagaaguggaugaccaucggcgugaccggcagcgacagcaaggccguggccguggugcacuacggcggcgugcccaccgacguggugaacagcugggccggcgacauccugagaacccaggagagcagcugcaccugcauccagggcaacugcuacugggugaugaccgacggccccgccaacagacaggcccaguacagaaucuacaaggccaaccagggcaaggugaucggccagaccgacaucagcuucaacggcggccacaucgaggagugcagcugcuaccccaacgacggcaagguggagugcgugugcagagacaacuggaccggcaccaacagacccgugcuggugaucagccccgaccugagcuacagagugggcuaccugugcgccggccugcccagcgacacccccagaggcgaggacgcccaguucaccggcagcugcaccagccccaugggcaaccagggcuacggcgugaagggcuucggcuucagacagggcaccgacguguggaugggcagaaccaucagccagaccagcagaagcggcuucgagauccugagagugaagaacggcuggacccagaccagcaaggagcaggugagaaagcagguggugguggacaaccugaacuggagcggcuacagcggcagcuucacccugcccaucgagcugagcggcaaggacugccuggugcccugcuucuggguggagaugaucagaggcaagcccgaggagaagagcaucuggaccagcagcagcagcaucgugaugugcggcguggacuacgagguggccgacuggagcuggcacgacggcgccauccugcccuucgacaucgacaagauguga

SEQ ID NO: 176205 - RNA, 1413 nt, Artificial Sequence
  derived and/or modified sequence opt4 from neuraminidase__InfluenzaA__AGQ81934
augaaccccaaccagaagauccugugcaccagcgccaccgccaucgugaucggcaccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucacccagaucagcaacaccaacauccagauggaggagagagccagcagagacuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcagaauccugaagugggagagccugaccggcaccgccaagcacaucgaggagugcagcugcuacggcgagagaaccggcaucaccugcaccugcagagacaacuggcagggcagcaacagacccgugaucagaaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccagugggacuggcccgacggcgccaagaucgaguacuuccuguga

SEQ ID NO: 176206 - RNA, 1413 nt, Artificial Sequence; identical to SEQ ID NO: 176205
  derived and/or modified sequence opt4 from neuraminidase__InfluenzaA__AGQ81935

SEQ ID NO: 176207 - RNA, 1413 nt, Artificial Sequence; identical to SEQ ID NO: 176205
  derived and/or modified sequence opt4 from neuraminidase__InfluenzaA__AGQ81936

SEQ ID NO: 176208 - RNA, 1413 nt, Artificial Sequence; identical to SEQ ID NO: 176205
  derived and/or modified sequence opt4 from neuraminidase__InfluenzaA__AGQ81937

SEQ ID NO: 176209 - RNA, 1413 nt, Artificial Sequence; identical to SEQ ID NO: 176205
  derived and/or modified sequence opt4 from neuraminidase__InfluenzaA__AGQ81938

SEQ ID NO: 176210 - RNA, 1413 nt, Artificial Sequence; identical to SEQ ID NO: 176205
  derived and/or modified sequence opt4 from neuraminidase__InfluenzaA__AGQ81939

SEQ ID NO: 176211 - RNA, 1413 nt, Artificial Sequence
  derived and/or modified sequence opt4 from neuraminidase__InfluenzaA__AGQ81940
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucacccagaucagcaacaccaacauccagauggaggagagagccagcaagggcuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccuggccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176212 - RNA, 1413 nt, Artificial Sequence
  derived and/or modified sequence opt4 from neuraminidase__InfluenzaA__AGQ81941
augaaccccaaccagaagauccugugcaccagcgccaccgccaucaucaucggcaccaucgccgugcugaucggcguggccaaccugggccugaacaucggccugcaccugaagcccggcugcaacugcagccacagccagcccgaggccaccaacaccagccagaccaucaucaacaacuacuacaacgagaccaacaucacccagaucagcaacaccaacauccagauggaggagagacccaacagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaguguacuacuucagagagggcaagauccugaagugggagagccugaccggcaccgccagacacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccagugggacuggcccgacggcgccaagaucgaguacuuccuguga

SEQ ID NO: 176213 - RNA, 1413 nt, Artificial Sequence
  derived and/or modified sequence opt4 from neuraminidase__InfluenzaA__AGQ81942
augaaccccaaccagaagauccugugcaccagcgccaccgccaucaucaucggcaccaucgccgugcugaucggcguggccaaccugggccugaacaucggccugcaccugaagcccggcugcaacugcagccacagccagcccgaggccaccaacaccagccagaccaucaucaacaacuacuacaacgagaccaacaucacccagaucagcaacaccaacauccagauggaggagagacccagcagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccaucgugugguacaacagaagacccguggccgagaucaacaccugggccagaaacauccugagaacccaggagagcgagugcgugugccacaacggcgugugccccgugguguucaccgacggcagcgccaccggccccgccgacaccagaguguacuacuucagagagggcaagauccugaagugggagagccugaccggcaccgccagacacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucauccugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccagugggacuggcccgacggcgccaagaucgaguacuuccuguga

SEQ ID NO: 176214 - RNA, 1413 nt, Artificial Sequence
  derived and/or modified sequence opt4 from neuraminidase__InfluenzaA__AGQ81943
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucacccagaucagcaacaccaacauccagauggaggagagaaccagcagaggcuucaacaaccugaccaagggccugugcaccaucaacagcuggcacaucuacggcaaggacaacgccaucagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcagaauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176215 - RNA, 1413 nt, Artificial Sequence; identical to SEQ ID NO: 176205
  derived and/or modified sequence opt4 from neuraminidase__InfluenzaA__AGQ81944

SEQ ID NO: 176216 - RNA, 1413 nt, Artificial Sequence
  derived and/or modified sequence opt4 from neuraminidase__InfluenzaA__AGQ81947
augaaccccaaccagaagauccugugcaccagcgccaccgcccuggugaucggcaccaucgccgugcugaucggcaucgccaaccugggccugaacaucggccugcaccugaagcccagcugcaacugcagccacagccagcccgaggccaccaacaccagccagaccaucaucaacaacuacuacaacgagaccaacaucacccagaucagcaacaccaacauccagauggaggagagagccagcagaagcuucaacaaccugaccaagggccugugcaccaucaacagcuggcacaucuacggcaaggacaacgccaucagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176217 - RNA, 1413 nt, Artificial Sequence
  derived and/or modified sequence opt4 from neuraminidase__InfluenzaA__AGQ81948
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucacccagaucagcaacaccaacauccagauggaggagagaaccagcagaggcuucaacaaccugaccaagggccugugcaccaucaacagcuggcacaucuacggcaaggacaacgccaucagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcagaauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgagugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176218 - RNA, 1413 nt, Artificial Sequence
  derived and/or modified sequence opt4 from neuraminidase__InfluenzaA__AGQ81951
augaaccccaaccagaagauccugugcaccagcgccaccgccaucgugaucggcaccaucgccgugcugaucggcguggccaaccugggccugaacaucggccugcaccugaagcccggcugcaacugcagccagagccagcccgaggccaccaacaccagccagaccaucaucaacaacuacuacaacgagaccaacaucacccagaucagcaacaccaacauccagauggaggagagagccaacagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaguguacuacuucagagagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176219 - RNA, 1413 nt, Artificial Sequence
  derived and/or modified sequence opt4 from neuraminidase__InfluenzaA__AGQ81952
augaaccccaaccagaagauccugugcaccagcgccaccgccaucgugaucggcaccaucgccgugcugaucggcguggccaaccugggccugaacaucggccugcaccugaagcccggcugcaacugcagccacagccagcccgaggccaccaacaccagccagaccaucaucaacaacuacuacaacgagaccaacaucacccagaucagcaacaccaacauccagauggaggagagagccaacagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaguguacuacuucagagagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176220 - RNA, 1413 nt, Artificial Sequence
  derived and/or modified sequence opt4 from neuraminidase__InfluenzaA__AGQ81954
augaaccccaaccagaagauccugugcaccagcgccaccgccaucgugaucggcaccaucgccgugcugaucggcguggccaaccugggccugaacaucggccugcaccugaagcccagcugcaacugcagccacagccagcccgaggccaccaacaccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaguguacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176221 - RNA, 1413 nt, Artificial Sequence
  derived and/or modified sequence opt4 from neuraminidase__InfluenzaA__AGQ81956
augaaccccaaccagaagauccugugcaccagcgccaccgccaucgugaucggcaccaucgccgugcugaucggcguggccaaccugggccugaacaucggccugcaccugaagcccagcugcaacugcagccacagccagcccgaggccaccaacaccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccaucgugugguacaacagaagacccguggccgagaucaacaccugggccagaaacauccugagaacccaggagagcgagugcgugugccacaacggcgugugccccgugguguucaccgacggcagcgccaccggccccgccgacaccagaguguacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176222 - RNA, 1413 nt, Artificial Sequence
  derived and/or modified sequence opt4 from neuraminidase__InfluenzaA__AGQ81957
augaaccccaaccagaagauccugugcaccagcgccaccgccaucgugaucggcaccaucgccgugcugaucggcaucgccaaccugggccugaacaucggccugcaccugaagcccagcugcaacugcagccacagccagcccgaggccaccaacaccagccagaucaucaucaacaacuacuacaacgagaccaacaucacccaggugagcaacaccaacauccagauggaggagagagccagcagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccgugcagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176223 - RNA, 1413 nt, Artificial Sequence; identical to SEQ ID NO: 176205
  derived and/or modified sequence opt4 from neuraminidase__InfluenzaA__AGQ81958

SEQ ID NO: 176224 - RNA, 1413 nt, Artificial Sequence; identical to SEQ ID NO: 176205
  derived and/or modified sequence opt4 from neuraminidase__InfluenzaA__AGQ81959

SEQ ID NO: 176225 - RNA, 1413 nt, Artificial Sequence
  derived and/or modified sequence opt4 from neuraminidase__InfluenzaA__AGQ81960
augaaccccaaccagaagauccugugcaccagcgccaccgccaucgugaucggcaccaucgccgugcugaucggcaucgccaaccugggccugaacaucggccugcaccugaagcccaacugcaacugcagcagaagccagcccgagaccaccaacaccagccagaccaucaucaacaacuacuacaacgagaccaacaucacccagaucagcaacaccaacauccagauggaggagagagccagcagagacuucaacaaccugaccaagggccugugcaccaucaacagcuggcacaucuacggcaaggacaacgccgugagaaucggcgagaacagcgacgugcuggugaccagagagcccuacgugagcugcgaccccaacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccgagaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccagugggacuggcccgacggcgccaagaucgaguacuuccuguga

SEQ ID NO: 176226 - RNA, 1413 nt, Artificial Sequence; identical to SEQ ID NO: 176218
  derived and/or modified sequence opt4 from neuraminidase__InfluenzaA__AGQ81961

SEQ ID NO: 176227 - RNA, 1413 nt, Artificial Sequence; identical to SEQ ID NO: 176218
  derived and/or modified sequence opt4 from neuraminidase__InfluenzaA__AGQ81962

SEQ ID NO: 176228 - RNA, 1413 nt, Artificial Sequence
  derived and/or modified sequence opt4 from neuraminidase__InfluenzaA__AGQ81963
augaaccccaaccagaagauccugugcaccagcgccaccgccaucgugaucggcaccaucgccgugcugaucggcaucgccaaccugggccugaacaucggccugcaccugaagcccagcugcaacugcagccacagccagcccgaggagaccaacaccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagaacagcgacgugcuggugaccagagagcccuacgugagcugcgaccccaacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcgugugcaucagcggccccaacgacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgcccacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacuggaccgagggcgacugcuacagagccugcuucuacguggagcugaucagaggcagacccaaggaggacaaggugugguggaccagcaacagcaucgugagcaugugcagcagcaccgaguuccugggccagugggacuggcccgacggcgccaagaucgaguacuuccuguga

SEQ ID NO: 176229 - RNA, 1413 nt, Artificial Sequence
  derived and/or modified sequence opt4 from neuraminidase__InfluenzaA__AGQ81964
augaaccccaaccagaagauccugugcaccagcgccaccgccaucgugaucggcaccaucgccgugcugaucggcaucgccaaccugggccugaacaucggccugcaccugaagcccagcugcaacugcagccacagcaagcccgaggagaccaacgccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaccagcaccaccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176230 - RNA, 1413 nt, Artificial Sequence
  derived and/or modified sequence opt4 from neuraminidase__InfluenzaA__AGQ81966
augaaccccaaccagagaauccugugcaccagcgccaccgccaucgugaucggcaccaucgccgugcugaucggcguggccaaccugggccugaacaucggccugcaccugaagcccggcugcaacugcagccacagccagcccgaggccaccaacaccagccagaccaucaucaacaacuacuacaacgagaccaacaucacccagaucagcaacaccaacauccagauggaggagagagccaacagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaguguacuacuucagagagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176231 - RNA, 1413 nt, Artificial Sequence
  derived and/or modified sequence opt4 from neuraminidase__InfluenzaA__AGQ81967
augaaccccaaccagaagauccugugcaccagcgccaccgccaucgugaucggcaucaucgccgugcugaucggcaucgccaaccugggccugaacaucggccugcaccugaagcccagcugcaacugcagccacagccagcccgaggccaccaacgccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgagaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaucaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176232 - RNA, 1413 nt, Artificial Sequence
  derived and/or modified sequence opt4 from neuraminidase__InfluenzaA__AGQ81968
augaaccccaaccagaagauccugugcaccagcgccaccgccaucgugaucggcaucaucgccgugcugaucggcaucgccaaccugggccugaacaucggccugcaccugaagcccagcugcaacugcagccacagccagcccgaggccaccaacgccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagaacagcgacauccuggugaccagagagcccuacgugagcugcgaccccgacgagugcagauucuacgcccugagccagggcaccaccaucagaggcaagcacagcaacggcaccauccacgacagaagccaguacagaagccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgagaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucaucgacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176233 - RNA, 1413 nt, Artificial Sequence
  derived and/or modified sequence opt4 from neuraminidase__InfluenzaA__AGQ81969
augaaccccaaccagaagauccugugcaccagcgccaccgccaucgugaucggcaucaucgccgugcugaucggcaucgccaaccugggccugaacaucggccugcaccugaagcccagcugcaacugcagccacagccagcccgaggagaccaacgccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgagaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacaacaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaucaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176234 - RNA, 1413 nt, Artificial Sequence
  derived and/or modified sequence opt4 from neuraminidase__InfluenzaA__AGQ81970
augaaccccaaccagaagauccugugcaccagcgccaccgccaucgugaucggcaccaucgccgugcugaucggcaucgccaaccugggccugaacaucggccugcaccugaagcccagcugcaacugcagccacagccagcccgaggagaccaacgccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacaagagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagccccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacgugggcaagugcaacgaccccuaccccggcaacagcaacaacggcgugaagggcuucagcuaccuggacggcgugaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176235 - RNA, 1413 nt, Artificial Sequence
  derived and/or modified sequence opt4 from neuraminidase__InfluenzaA__AGQ81971
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucacccagaucagcaacaccaacauccagauggaggagagaaccagcagaggcuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacagcagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176236 - RNA, 1413 nt, Artificial Sequence
  derived and/or modified sequence opt4 from neuraminidase__InfluenzaA__AGQ81972
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucacccagaucagcaacaccaacauccagauggaggagagagccagcagaggcuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176237 - RNA, 1413 nt, Artificial Sequence
  derived and/or modified sequence opt4 from neuraminidase__InfluenzaA__AGQ81973
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucacccagaucagcaacaccaacauccagauggaggagagaaccagcagaggcuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacaccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176238 - RNA, 1413 nt, Artificial Sequence; identical to SEQ ID NO: 176218
  derived and/or modified sequence opt4 from neuraminidase__InfluenzaA__AGQ81974

SEQ ID NO: 176239 - RNA, 1398 nt, Artificial Sequence
  derived and/or modified sequence opt4 from neuraminidase__InfluenzaA__AGQ81975
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaaguggcugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccgacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgacggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176240 - RNA, 1398 nt, Artificial Sequence
  derived and/or modified sequence opt4 from neuraminidase__InfluenzaA__AGQ81977
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccgacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgacggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176241 - RNA, 1398 nt, Artificial Sequence
  derived and/or modified sequence opt4 from neuraminidase__InfluenzaA__AGQ81979
augaaccccaaccagaagauccugugcaccagcgccaccgccaucaucaucggcgccaucgccgcccugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccgacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgacggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 176242 - RNA, 1398 nt, Artificial Sequence; identical to SEQ ID NO: 176240
  derived and/or modified sequence opt4 from neuraminidase__InfluenzaA__AGQ81980

SEQ ID NO: 176243 - RNA, 1350 nt, Artificial Sequence
  derived and/or modified sequence opt4 from neuraminidase__InfluenzaA__AGQ88501
augaaccccaaccagaagaucgugaccaucggcagcaucugcauggugaucggcaucgugagccugaugcugcagaucggcaacaugaucagcaucugggugagccacagcauccagaccggcaaccagcaccagaccgagcccaucagaaacaccaacuuccugaccgagaacgccguggccagcguggcccugagcggcaacagcagccugugccccaucagaggcugggccgugcacagcaaggacaacagcaucagaaucggcagcaagggcgacguguucgugaucagagagcccuucaucagcugcagcaaccuggagugcagaaccuucuuccugacccagggcgcccugcugaacgacaagcacagcaacggcaccgugaaggacagaagcccccacagaacccugaugagcugccccaucggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcaccugcgugaacggcagcugcuucaccgugaugaccgacggccccagcaacggccaggccagcuacaagaucuucaagaucgagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcgagggcagcugcggccccgugagccccaacggcgccuacggcgugaagggcuucagcuucaaguacggcaacggcguguggaucggcagaaccaagagcacccacagcagaagcggcuucgagaugaucugggaccccaacggcuggaccggcaccgacagcgaguucagcaugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 176244 - RNA, 1401 nt, Artificial Sequence; identical to SEQ ID NO: 176122
  derived and/or modified sequence opt4 from neuraminidase__InfluenzaA__AGR33906

SEQ ID NO: 176245 - RNA, 1401 nt, Artificial Sequence
  derived and/or modified sequence opt4 from neuraminidase__InfluenzaA__AGR33908
augaaccccaaccagaagaucaccgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccccgacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcgaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccaucaucuacaucaacaugguggacuacagcaucgagagcagauacgugugcagcggccuggugggcgacacccccagaaacgacgacagcaccagcagcagcaacugcagagaccccaacaacgagagaggcgcccccggcgugaagggcugggccuucgacgacggcaacgacguguggaugggcagaaccaucaagaacggcagcagaagcggcuacgagaccuucagagugaucaacggcuggaccauggccaacagcaagagccagaucaacagacaggugaucguggacagcgacaacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccgacaucaacuucaugcccaucuga

SEQ ID NO: 176246 - RNA, 1401 nt, Artificial Sequence
  derived and/or modified sequence opt4 from neuraminidase__InfluenzaA__AGR33910
augaaccccaaccagaagaucaucgccaucggcagcgugagccugaccaucgccaucaucugcuuccugaugcagaucgccauccugaccaccaccaugacccugcacuucaagcagaacgagugcagcaagcccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagcuucggcaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagaccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucagaaacgacagcagaagcggcuacgagaccuucagaguggugaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176247 - RNA, 1401 nt, Artificial Sequence
  derived and/or modified sequence opt4 from neuraminidase__InfluenzaA__AGR33911
augaaccccaaccagaagaucaucgccaucggcagcgugagccugaccaucgccaucaucugcuuccugaugcagaucgccauccugaccaccaccaugacccugcacuucaagcagaacgagugcagcaaccccagcaacaaccagguggugcccugcgagcccauccugaucgagagaaacaccgugcaccugaacagcaccaccaucgagaaggaggugugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaaccacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucagaaacaacagcagaagcggcuacgagaccuucagaguggugaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 176248 - RNA, 1356 nt, Artificial Sequence; identical to SEQ ID NO: 176163
  derived and/or modified sequence opt4 from neuraminidase__InfluenzaA__AGR33912

SEQ ID NO: 176249 - RNA, 1356 nt, Artificial Sequence; identical to SEQ ID NO: 176193
  derived and/or modified sequence opt4 from neuraminidase__InfluenzaA__AGR33913

SEQ ID NO: 176250 - RNA, 1356 nt, Artificial Sequence; identical to SEQ ID NO: 176163
  derived and/or modified sequence opt4 from neuraminidase__InfluenzaA__AGR33915

SEQ ID NO: 176251 - RNA, 1356 nt, Artificial Sequence
  derived and/or modified sequence opt4 from neuraminidase__InfluenzaA__AGR33916
augaaccccaaccagaagcuguucgccagcagcggcguggccaucgcccugagcgugcugaaccugcugaucggccugagcaacgugggccugaacgugagccugcaccugaaggagaccggccccaagcaggaggagaaccugaccugcaugaccaccaaggagaccgagcugggcacccccagcuaccugcugcugaacaagagccugugcaacguggagggcuggguggugaucgccaaggacaacgccgugagauucggcgagagcgagcagaucaucaucaccagagagcccuacgugagcugcgaccccaacggcugcaagauguacgcccugcaccagggcaccaccaucagaaacaagcacagcaacggcaccauccacgacagaaccgccuucagaggccugaucagcaccccccugggcaccccccccaccgugagcaacagcgacuucaucugcgugggcuggagcagcaccaccugccacgacggcaucggcagaaugaccaucugcauccagggcaacaacgacaacgccaccgccaccguguacuacaacagaagacugaccaccaccaucaagaccugggccagaaacauccugagaacccaggagagcgagugcgugugccacaacggcaccugcgccguggugaugaccgacggcagcgccagcagccaggcccacaccaaggugauguacuuccacaagggccugguggugaaggaggaggcccugaagggcagcgccaagcacaucgaggagugcagcugcuacggccacaaccagaaggugaccugcgugugcagagacaacuggcagggcgccaacagacccaucaucgagaucgacaugaacacccuggagcacaccagcagauacgugugcaccggcauccugaccgacaccagcagacccggcgacaagcccaccggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccggcaucgaccccaacagcagaaucgccgagagacaggagaucguggacaacagcaacuggagcggcuacagcggcagcuucaucgacuacuggaacgacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176252 - RNA, 1356 nt, Artificial Sequence; identical to SEQ ID NO: 176193
  derived and/or modified sequence opt4 from neuraminidase__InfluenzaA__AGR33917

SEQ ID NO: 176253 - RNA, 1356 nt, Artificial Sequence; identical to SEQ ID NO: 176163
  derived and/or modified sequence opt4 from neuraminidase__InfluenzaA__AGR33918

SEQ ID NO: 176254 - RNA, 1398 nt, Artificial Sequence; identical to SEQ ID NO: 176240
  derived and/or modified sequence opt4 from neuraminidase__InfluenzaA__AGR33919

SEQ ID NO: 176255 - RNA, 1413 nt, Artificial Sequence
  derived and/or modified sequence opt4 from neuraminidase__InfluenzaA__AGR45094
augaaccccaaccagaagaucaucaccaucggcagcaucagcauggccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggccccgccagcuacagaaucuucaagaucgagaagggcaagaucaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagcagcagaaagggcuucgagaugaucugggaccccaacggcuggaccgacaccgacagcgacuucagcgugaagcaggacguggugcccaugaccgacuggagcggcuacagcggcagcuucgugcagcaccccgagcugaccggccuggacugcaugagacccugcuucuggguggagcugaucagaggcagacccagagagaacaccaccaucuggaccagcggcagcagcaucagcuucugcggcgugaacagcgacaccgccaacuggagcuggcccgacgacgccgagcugccccugaccaucgacaaguga

SEQ ID NO: 176256 - RNA, 1413 nt, Artificial Sequence; identical to SEQ ID NO: 171450
  derived and/or modified sequence opt4 from neuraminidase__InfluenzaA__AGR49780

SEQ ID NO: 176257 - RNA, 1410 nt, Artificial Sequence
  derived and/or modified sequence opt4 from neuraminidase__InfluenzaA__AGR49804
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcugaccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176258 - RNA, 1413 nt, Artificial Sequence; identical to SEQ ID NO: 171450
  derived and/or modified sequence opt4 from neuraminidase__InfluenzaA__AGR49820

SEQ ID NO: 176259 - RNA, 1410 nt, Artificial Sequence; identical to SEQ ID NO: 168610
  derived and/or modified sequence opt4 from neuraminidase__InfluenzaA__AGR49832

SEQ ID NO: 176260 - RNA, 1413 nt, Artificial Sequence; identical to SEQ ID NO: 171450
  derived and/or modified sequence opt4 from neuraminidase__InfluenzaA__AGR49844

SEQ ID NO: 176261 - RNA, 1413 nt, Artificial Sequence; identical to SEQ ID NO: 171450
  derived and/or modified sequence opt4 from neuraminidase__InfluenzaA__AGR49856

SEQ ID NO: 176262 - RNA, 1413 nt, Artificial Sequence; identical to SEQ ID NO: 171450
  derived and/or modified sequence opt4 from neuraminidase__InfluenzaA__AGR49868

SEQ ID NO: 176263 - RNA, 1410 nt, Artificial Sequence; identical to SEQ ID NO: 169248
  derived and/or modified sequence opt4 from neuraminidase__InfluenzaA__AGR49880

SEQ ID NO: 176264 - RNA, 1410 nt, Artificial Sequence; identical to SEQ ID NO: 171004
  derived and/or modified sequence opt4 from neuraminidase__InfluenzaA__AGR49891

SEQ ID NO: 176265 - RNA, 1410 nt, Artificial Sequence
  derived and/or modified sequence opt4 from neuraminidase__InfluenzaA__AGR49903
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176266 - RNA, 1410 nt, Artificial Sequence; identical to SEQ ID NO: 168610
  derived and/or modified sequence opt4 from neuraminidase__InfluenzaA__AGR49915

SEQ ID NO: 176267 - RNA, 1410 nt, Artificial Sequence; identical to SEQ ID NO: 168610
  derived and/or modified sequence opt4 from neuraminidase__InfluenzaA__AGR49927

SEQ ID NO: 176268 - RNA, 1410 nt, Artificial Sequence
  derived and/or modified sequence opt4 from neuraminidase__InfluenzaA__AGR49939
augaaccccaacaagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176269 - RNA, 1410 nt, Artificial Sequence; identical to SEQ ID NO: 169205
  derived and/or modified sequence opt4 from neuraminidase__InfluenzaA__AGR49951

SEQ ID NO: 176270 - RNA, 1410 nt, Artificial Sequence
  derived and/or modified sequence opt4 from neuraminidase__InfluenzaA__AGR49963
augaaccccaacaagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcaagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176271 - RNA, 1410 nt, Artificial Sequence; identical to SEQ ID NO: 169248
  derived and/or modified sequence opt4 from neuraminidase__InfluenzaA__AGR49975

SEQ ID NO: 176272 - RNA, 1413 nt, Artificial Sequence; identical to SEQ ID NO: 171450
  derived and/or modified sequence opt4 from neuraminidase__InfluenzaA__AGR49986

SEQ ID NO: 176273 - RNA, 1413 nt, Artificial Sequence; identical to SEQ ID NO: 171450
  derived and/or modified sequence opt4 from neuraminidase__InfluenzaA__AGR49998

SEQ ID NO: 176274 - RNA, 1410 nt, Artificial Sequence; identical to SEQ ID NO: 169248
  derived and/or modified sequence opt4 from neuraminidase__InfluenzaA__AGR50010

SEQ ID NO: 176275 - RNA, 1410 nt, Artificial Sequence; identical to SEQ ID NO: 169248
  derived and/or modified sequence opt4 from neuraminidase__InfluenzaA__AGR50021

SEQ ID NO: 176276 - RNA, 1410 nt, Artificial Sequence; identical to SEQ ID NO: 169258
  derived and/or modified sequence opt4 from neuraminidase__InfluenzaA__AGR50032

SEQ ID NO: 176277 - RNA, 1410 nt, Artificial Sequence
  derived and/or modified sequence opt4 from neuraminidase__InfluenzaA__AGR50043
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176278 - RNA, 1410 nt, Artificial Sequence; identical to SEQ ID NO: 169248
  derived and/or modified sequence opt4 from neuraminidase__InfluenzaA__AGR50055

SEQ ID NO: 176279 - RNA, 1410 nt, Artificial Sequence
  derived and/or modified sequence opt4 from neuraminidase__InfluenzaA__AGR50066
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176280 - RNA, 1410 nt, Artificial Sequence; identical to SEQ ID NO: 169248
  derived and/or modified sequence opt4 from neuraminidase__InfluenzaA__AGR50077

SEQ ID NO: 176281 - RNA, 1410 nt, Artificial Sequence; identical to SEQ ID NO: 169248
  derived and/or modified sequence opt4 from neuraminidase__InfluenzaA__AGR50088

SEQ ID NO: 176282 - RNA, 1410 nt, Artificial Sequence; identical to SEQ ID NO: 169248
  derived and/or modified sequence opt4 from neuraminidase__InfluenzaA__AGR50099

SEQ ID NO: 176283 - RNA, 1410 nt, Artificial Sequence; identical to SEQ ID NO: 169248
  derived and/or modified sequence opt4 from neuraminidase__InfluenzaA__AGR50110

SEQ ID NO: 176284 - RNA, 1410 nt, Artificial Sequence
  derived and/or modified sequence opt4 from neuraminidase__InfluenzaA__AGR50121
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugcccagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176285 - RNA, 1410 nt, Artificial Sequence
  derived and/or modified sequence opt4 from neuraminidase__InfluenzaA__AGR50132
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgccaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176286 - RNA, 1410 nt, Artificial Sequence; identical to SEQ ID NO: 169248
  derived and/or modified sequence opt4 from neuraminidase__InfluenzaA__AGR50143

SEQ ID NO: 176287 - RNA, 1410 nt, Artificial Sequence; identical to SEQ ID NO: 169248
  derived and/or modified sequence opt4 from neuraminidase__InfluenzaA__AGR50154

SEQ ID NO: 176288 - RNA, 1413 nt, Artificial Sequence; identical to SEQ ID NO: 171450
  derived and/or modified sequence opt4 from neuraminidase__InfluenzaA__AGR50165

SEQ ID NO: 176289 - RNA, 1410 nt, Artificial Sequence; identical to SEQ ID NO: 169248
  derived and/or modified sequence opt4 from neuraminidase__InfluenzaA__AGR50177

SEQ ID NO: 176290 - RNA, 1410 nt, Artificial Sequence; identical to SEQ ID NO: 169248
  derived and/or modified sequence opt4 from neuraminidase__InfluenzaA__AGR50188

SEQ ID NO: 176291 - RNA, 1410 nt, Artificial Sequence; identical to SEQ ID NO: 169248
  derived and/or modified sequence opt4 from neuraminidase__InfluenzaA__AGR50199

SEQ ID NO: 176292 - RNA, 1410 nt, Artificial Sequence; identical to SEQ ID NO: 169248
  derived and/or modified sequence opt4 from neuraminidase__InfluenzaA__AGR50210

SEQ ID NO: 176293 - RNA, 1410 nt, Artificial Sequence; identical to SEQ ID NO: 169248
  derived and/or modified sequence opt4 from neuraminidase__InfluenzaA__AGR50221

SEQ ID NO: 176294 - RNA, 1410 nt, Artificial Sequence
  derived and/or modified sequence opt4 from neuraminidase__InfluenzaA__AGR50232
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccaacaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176295 - RNA, 1410 nt, Artificial Sequence; identical to SEQ ID NO: 169248
  derived and/or modified sequence opt4 from neuraminidase__InfluenzaA__AGR50243

SEQ ID NO: 176296 - RNA, 1410 nt, Artificial Sequence; identical to SEQ ID NO: 169248
  derived and/or modified sequence opt4 from neuraminidase__InfluenzaA__AGR50254

SEQ ID NO: 176297 - RNA, 1410 nt, Artificial Sequence; identical to SEQ ID NO: 169248
  derived and/or modified sequence opt4 from neuraminidase__InfluenzaA__AGR50265

SEQ ID NO: 176298 - RNA, 1410 nt, Artificial Sequence
  derived and/or modified sequence opt4 from neuraminidase__InfluenzaA__AGR50276
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccgagcagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176299 - RNA, 1410 nt, Artificial Sequence; identical to SEQ ID NO: 169248
  derived and/or modified sequence opt4 from neuraminidase__InfluenzaA__AGR50287

SEQ ID NO: 176300 - RNA, 1410 nt, Artificial Sequence
  derived and/or modified sequence opt4 from neuraminidase__InfluenzaA__AGR50298
augaaccccaaccagaagaucaucaccaucggcagcgugugcaugaccaucggcauggccaaccugauccugcagaucggcaacaccaucagcaucuggaucagccacagcauccagcccggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176301 - RNA, 1410 nt, Artificial Sequence; identical to SEQ ID NO: 169248
  derived and/or modified sequence opt4 from neuraminidase__InfluenzaA__AGR50309

SEQ ID NO: 176302 - RNA, 1410 nt, Artificial Sequence; identical to SEQ ID NO: 169248
  derived and/or modified sequence opt4 from neuraminidase__InfluenzaA__AGR50320

SEQ ID NO: 176303 - RNA, 1410 nt, Artificial Sequence; identical to SEQ ID NO: 169248
  derived and/or modified sequence opt4 from neuraminidase__InfluenzaA__AGR50331

SEQ ID NO: 176304 - RNA, 1410 nt, Artificial Sequence
  derived and/or modified sequence opt4 from neuraminidase__InfluenzaA__AGR50342
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcgugaucagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176305 - RNA, 1410 nt, Artificial Sequence; identical to SEQ ID NO: 169248
  derived and/or modified sequence opt4 from neuraminidase__InfluenzaA__AGR50353

SEQ ID NO: 176306 - RNA, 1413 nt, Artificial Sequence; identical to SEQ ID NO: 171450
  derived and/or modified sequence opt4 from neuraminidase__InfluenzaA__AGR50364

SEQ ID NO: 176307 - RNA, 1410 nt, Artificial Sequence
  derived and/or modified sequence opt4 from neuraminidase__InfluenzaA__AGR55170
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaacagcaagcugcagaucaacagacagaucaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176308 - RNA, 1410 nt, Artificial Sequence; identical to SEQ ID NO: 166665
  derived and/or modified sequence opt4 from neuraminidase__InfluenzaA__AGR55180

SEQ ID NO: 176309 - RNA, 1410 nt, Artificial Sequence; identical to SEQ ID NO: 166665
  derived and/or modified sequence opt4 from neuraminidase__InfluenzaA__AGR55181

SEQ ID NO: 176310 - RNA, 1410 nt, Artificial Sequence; identical to SEQ ID NO: 166665
  derived and/or modified sequence opt4 from neuraminidase__InfluenzaA__AGR55183

SEQ ID NO: 176311 - RNA, 1410 nt, Artificial Sequence
  derived and/or modified sequence opt4 from neuraminidase__InfluenzaA__AGR55184
augaaccccaaccagaagaucaucaccaucggcagcgugagccugaccaucgccaccaucugcuuccugaugcagaucgccauccuggugaccaccgugacccugcacuucaagcagcacgagugcaacagcccccccaagaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 176312 - RNA, 1410 nt, Artificial Sequence
  derived and/or modified sequence opt4 from neuraminidase__InfluenzaA__AGR55185
augaaccccaaccagaagaucaucaccaucggcagcgugagccugaccaucgccaccaucugcuuccugaugcagaucgccauccuggugaccaccgugacccugcacuucaagcagcacgagugcaacagcccccccaagaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcagaaccuacggcaccggcagcuggcccgacggcgccgacaucaaccugaugcccaucuga

SEQ ID NO: 176313 - RNA, 1410 nt, Artificial Sequence
  derived and/or modified sequence opt4 from neuraminidase__InfluenzaA__AGR55186
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggagcccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 176314 - RNA, 1410 nt, Artificial Sequence; identical to SEQ ID NO: 166665
  derived and/or modified sequence opt4 from neuraminidase__InfluenzaA__AGR55187

SEQ ID NO: 176315 - RNA, 1410 nt, Artificial Sequence; identical to SEQ ID NO: 167234
  derived and/or modified sequence opt4 from neuraminidase__InfluenzaA__AGR55192

SEQ ID NO: 176316 - RNA, 1410 nt, Artificial Sequence
  derived and/or modified sequence opt4 from neuraminidase__InfluenzaA__AGR55195
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagaccacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176317 - RNA, 1410 nt, Artificial Sequence
  derived and/or modified sequence opt4 from neuraminidase__InfluenzaA__AGR55204
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcagaaccuacggcaccggcagcuggcccgacggcgccgacaucaaccugaugcccaucuga

SEQ ID NO: 176318 - RNA, 1410 nt, Artificial Sequence
  derived and/or modified sequence opt4 from neuraminidase__InfluenzaA__AGR55218
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176319 - RNA, 1410 nt, Artificial Sequence; identical to SEQ ID NO: 175909
  derived and/or modified sequence opt4 from neuraminidase__InfluenzaA__AGT18726

SEQ ID NO: 176320 - RNA, 1410 nt, Artificial Sequence
  derived and/or modified sequence opt4 from neuraminidase__InfluenzaA__AGT18727
augaaccccaaccagaagaucaucaccaucggcagcgugugcaugaccaucggcauggccaaccugauccugcagaucggcaacaucaucagcaucuggaucagccacagcauccagcugggcagccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggagcggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176321 - RNA, 1410 nt, Artificial Sequence; identical to SEQ ID NO: 175909
  derived and/or modified sequence opt4 from neuraminidase__InfluenzaA__AGT18728

SEQ ID NO: 176322 - RNA, 1410 nt, Artificial Sequence
  derived and/or modified sequence opt4 from neuraminidase__InfluenzaA__AGT18729
augaaccccaaccagaagaucaucaccaucggccaggugugcaugaccaucggcauggccaaccugauccugcagaucggcaacaucaucagcaucuggaucagccacagcauccagcugggcagccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176323 - RNA, 1410 nt, Artificial Sequence
  derived and/or modified sequence opt4 from neuraminidase__InfluenzaA__AGT18730
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaucaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176324 - RNA, 1410 nt, Artificial Sequence; identical to SEQ ID NO: 175909
  derived and/or modified sequence opt4 from neuraminidase__InfluenzaA__AGT18731

SEQ ID NO: 176325 - RNA, 1410 nt, Artificial Sequence
  derived and/or modified sequence opt4 from neuraminidase__InfluenzaA__AGT18732
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagaggcagcagcaucagcuucugcggcgugaacagcgacaccgugggcuggagcuggcccgacggcgccgagcugcccuucaccaucgacaaguga

SEQ ID NO: 176326 - RNA, 1410 nt, Artificial Sequence
  derived and/or modified sequence opt4 from neuraminidase__InfluenzaA__AGT18733
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagagcaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcagaagcuucugcggcgugaacagcgacaccgugggcuggagcuggcccgacggcgccgagcugcccuucaccaucgacaaguga

SEQ ID NO: 176327 - RNA, 1410 nt, Artificial Sequence
  derived and/or modified sequence opt4 from neuraminidase__InfluenzaA__AGT18762
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugacccugugcgagcccaucaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176328 - RNA, 1410 nt, Artificial Sequence
  derived and/or modified sequence opt4 from neuraminidase__InfluenzaA__AGT18764
augaaccccaaccagaugaucaucaccaucggcagcgugagccugaccagcagcaccaucugcuucuucaugcagaccgccagcuucaucaccaccgugacccugcacaucaagcagcacgaguuccacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagaagcagcaacagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176329 - RNA, 1410 nt, Artificial Sequence
  derived and/or modified sequence opt4 from neuraminidase__InfluenzaA__AGT18765
augaaccccaaccagaagaucaucaccaucggcagcgugagccugaccaucagcaccaucugcuucuucaugcagaucgccauccugaucaccaccgugacccugcacuucaagcagcacgaguuccacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagaagcagcaacagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176330 - RNA, 1410 nt, Artificial Sequence
  derived and/or modified sequence opt4 from neuraminidase__InfluenzaA__AGT18766
augaaccccaaccagaagaucaucaccaucggcagcgugagccugaccaucagcaccaucugccuguucaugcagaucgccauccugaucaccaccgugacccugcacuucaagcagcacgaguuccacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagaagcagcaacagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaagcccaucuga

SEQ ID NO: 176331 - RNA, 1410 nt, Artificial Sequence
  derived and/or modified sequence opt4 from neuraminidase__InfluenzaA__AGT18767
augaaccccaaccagaagaucaucaccaucggcagcgugagccugaccaucagcaccaucugcuucuucaugcagaccgccagccugaucaccaccgugacccugcacuucaagcagcacgaguuccacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagaagcagcaacagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176332 - RNA, 1410 nt, Artificial Sequence
  derived and/or modified sequence opt4 from neuraminidase__InfluenzaA__AGT18768
augaaccccaaccagaagaucaucaccaucggcagcgugagccugaccaucagcaccaucugcuucuucaugcagaccgccagcuucaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagaagcagcaacagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176333 - RNA, 1410 nt, Artificial Sequence; identical to SEQ ID NO: 174666
  derived and/or modified sequence opt4 from neuraminidase__InfluenzaA__AGT18769

SEQ ID NO: 176334 - RNA, 1410 nt, Artificial Sequence
  derived and/or modified sequence opt4 from neuraminidase__InfluenzaA__AGT18770
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaacaaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176335 - RNA, 1410 nt, Artificial Sequence
  derived and/or modified sequence opt4 from neuraminidase__InfluenzaA__AGT18771
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176336 - RNA, 1410 nt, Artificial Sequence; identical to SEQ ID NO: 174666
  derived and/or modified sequence opt4 from neuraminidase__InfluenzaA__AGT18772

SEQ ID NO: 176337 - RNA, 1410 nt, Artificial Sequence
  derived and/or modified sequence opt4 from neuraminidase__InfluenzaA__AGT37104
augaaccccaaccagaagaucaucaccaucggcagcgugagccugaccaucgccaccaucugccugcugaugcagaucgccauccuggugaccaccgugacccugcacuucaagcaguacgagugcagcagcccccccaacaaccaggugaugcccugcgagcccaccaucaucgagagaaacaucaccaagaucguguaccugaccaacaccaccaucgagagagaggccugccccgagcuggccgaguacagacacuggagcaagccccagugcaagaucagaggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggccacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagaucauguucguggaggagggcaagaucgugcacaucagcccccuggccggcagcgcccagcacguggaggagugcagcugcuaccccaaguaccccggcgugagaugcgugugcagagacaacuggaagggcagcaacagacccaucguggacaucaacaugaaggacuacagcaucgugagcagcuacgugugcagcggccuggugggcgacacccccagaagaaacgacagcagcagcaccagcuacugccugaaccccaacaacgaggagggcggccacggcgugaagggcugggccuucgacgacggcgacgacguguggaugggcagaaccaucagcgagaagcugagacugggcuacgagaccuucaaggugaucggcggcuggagcaagcccaacagcaagcugcagaucaacagacagguggugguggacaucagcaacagaagcggcuacagcggcaucuucagcguggagggcaagagcugcaucaacagaugcuucuacguggagcugaucagaggcagaaagcaggagaacgaggugugguggaccagcaacagcaucgugguguucugcggcaccagcggcaccuacggcaccggcagcuggcccgacggcgccgacaucaaccugaugcccaucuga

SEQ ID NO: 176338 - RNA, 1410 nt, Artificial Sequence
  derived and/or modified sequence opt4 from neuraminidase__InfluenzaA__AGU69973
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugagaagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcggcaagcaggagaccgaggugcuguggaccagcaacagcaucgugguguucugcggcaccagcggcaccuacggcaccggcagcuggcccgacggcgccgaccugaaccugaugcccaucuga

SEQ ID NO: 176339 - RNA, 1410 nt, Artificial Sequence
  derived and/or modified sequence opt4 from neuraminidase__InfluenzaA__AGU92648
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaucugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176340 - RNA, 1410 nt, Artificial Sequence
  derived and/or modified sequence opt4 from neuraminidase__InfluenzaA__AGU92670
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaucugcgugugcagagacaacuggcacggcagcaacagacccugggugagcuucaaccagaaccuggaguaccagaucggcuacaucugcagcggcaucuucggcgacaaccccagacccgacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176341 - RNA, 1410 nt, Artificial Sequence
  derived and/or modified sequence opt4 from neuraminidase__InfluenzaA__AGU92681
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaccuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaucugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176342 - RNA, 1410 nt, Artificial Sequence
  derived and/or modified sequence opt4 from neuraminidase__InfluenzaA__AGU92692
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagagugggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucauccagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176343 - RNA, 1410 nt, Artificial Sequence; identical to SEQ ID NO: 176342
  derived and/or modified sequence opt4 from neuraminidase__InfluenzaA__AGU92703

SEQ ID NO: 176344 - RNA, 1410 nt, Artificial Sequence; identical to SEQ ID NO: 176342
  derived and/or modified sequence opt4 from neuraminidase__InfluenzaA__AGU92714

SEQ ID NO: 176345 - RNA, 1410 nt, Artificial Sequence; identical to SEQ ID NO: 176342
  derived and/or modified sequence opt4 from neuraminidase__InfluenzaA__AGU92725

SEQ ID NO: 176346 - RNA, 1410 nt, Artificial Sequence; identical to SEQ ID NO: 176342
  derived and/or modified sequence opt4 from neuraminidase__InfluenzaA__AGU92736

SEQ ID NO: 176347 - RNA, 1410 nt, Artificial Sequence; identical to SEQ ID NO: 176342
  derived and/or modified sequence opt4 from neuraminidase__InfluenzaA__AGU92747

SEQ ID NO: 176348 - RNA, 1410 nt, Artificial Sequence; identical to SEQ ID NO: 176342
  derived and/or modified sequence opt4 from neuraminidase__InfluenzaA__AGU92758

SEQ ID NO: 176349 - RNA, 1410 nt, Artificial Sequence; identical to SEQ ID NO: 176339
  derived and/or modified sequence opt4 from neuraminidase__InfluenzaA__AGU92769

SEQ ID NO: 176350 - RNA, 1410 nt, Artificial Sequence; identical to SEQ ID NO: 176339
  derived and/or modified sequence opt4 from neuraminidase__InfluenzaA__AGU92780

SEQ ID NO: 176351 - RNA, 1410 nt, Artificial Sequence
  derived and/or modified sequence opt4 from neuraminidase__InfluenzaA__AGU92791
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaucuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaucugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176352 - RNA, 1410 nt, Artificial Sequence; identical to SEQ ID NO: 176339
  derived and/or modified sequence opt4 from neuraminidase__InfluenzaA__AGU92802

SEQ ID NO: 176353 - RNA, 1410 nt, Artificial Sequence; identical to SEQ ID NO: 176339
  derived and/or modified sequence opt4 from neuraminidase__InfluenzaA__AGU92813

SEQ ID NO: 176354 - RNA, 1410 nt, Artificial Sequence; identical to SEQ ID NO: 176339
  derived and/or modified sequence opt4 from neuraminidase__InfluenzaA__AGU92824

SEQ ID NO: 176355 - RNA, 1410 nt, Artificial Sequence
  derived and/or modified sequence opt4 from neuraminidase__InfluenzaA__AGU92846
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagagugggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucgccuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucauccagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176356 - RNA, 1410 nt, Artificial Sequence
  derived and/or modified sequence opt4 from neuraminidase__InfluenzaA__AGU92868
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaaguucgccggcaacagcagccugugccccgugagcggcugggccaucuacagcaaggacaacagcgugagagugggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucauccagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176357 - RNA, 1410 nt, Artificial Sequence
  derived and/or modified sequence opt4 from neuraminidase__InfluenzaA__AGU92890
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagagugggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucauccagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176358 - RNA, 1410 nt, Artificial Sequence; identical to SEQ ID NO: 176339
  derived and/or modified sequence opt4 from neuraminidase__InfluenzaA__AGU92901

SEQ ID NO: 176359 - RNA, 1410 nt, Artificial Sequence; identical to SEQ ID NO: 176339
  derived and/or modified sequence opt4 from neuraminidase__InfluenzaA__AGU92912

SEQ ID NO: 176360 - RNA, 1410 nt, Artificial Sequence; identical to SEQ ID NO: 176339
  derived and/or modified sequence opt4 from neuraminidase__InfluenzaA__AGU92923

SEQ ID NO: 176361 - RNA, 1410 nt, Artificial Sequence; identical to SEQ ID NO: 176342
  derived and/or modified sequence opt4 from neuraminidase__InfluenzaA__AGU92934

SEQ ID NO: 176362 - RNA, 1410 nt, Artificial Sequence; identical to SEQ ID NO: 176342
  derived and/or modified sequence opt4 from neuraminidase__InfluenzaA__AGU92945

SEQ ID NO: 176363 - RNA, 1410 nt, Artificial Sequence; identical to SEQ ID NO: 176342
  derived and/or modified sequence opt4 from neuraminidase__InfluenzaA__AGU92956

SEQ ID NO: 176364 - RNA, 1410 nt, Artificial Sequence; identical to SEQ ID NO: 176339
  derived and/or modified sequence opt4 from neuraminidase__InfluenzaA__AGU92967

SEQ ID NO: 176365 - RNA, 1410 nt, Artificial Sequence; identical to SEQ ID NO: 176339
  derived and/or modified sequence opt4 from neuraminidase__InfluenzaA__AGU92978

SEQ ID NO: 176366 - RNA, 1410 nt, Artificial Sequence
  derived and/or modified sequence opt4 from neuraminidase__InfluenzaA__AGU92989
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagagugggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176367 - RNA, 1410 nt, Artificial Sequence; identical to SEQ ID NO: 176356
  derived and/or modified sequence opt4 from neuraminidase__InfluenzaA__AGU93000

SEQ ID NO: 176368 - RNA, 1410 nt, Artificial Sequence; identical to SEQ ID NO: 176357
  derived and/or modified sequence opt4 from neuraminidase__InfluenzaA__AGU93011

SEQ ID NO: 176369 - RNA, 1365 nt, Artificial Sequence; identical to SEQ ID NO: 172910
  derived and/or modified sequence opt4 from neuraminidase__InfluenzaA__AGU93022

SEQ ID NO: 176370 - RNA, 1410 nt, Artificial Sequence
  derived and/or modified sequence opt4 from neuraminidase__InfluenzaA__AGU93034
augaaccccacccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggccagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176371 - RNA, 1410 nt, Artificial Sequence; identical to SEQ ID NO: 175678
  derived and/or modified sequence opt4 from neuraminidase__InfluenzaA__AGU93045

SEQ ID NO: 176372 - RNA, 1410 nt, Artificial Sequence; identical to SEQ ID NO: 176339
  derived and/or modified sequence opt4 from neuraminidase__InfluenzaA__AGU93056

SEQ ID NO: 176373 - RNA, 1410 nt, Artificial Sequence; identical to SEQ ID NO: 174666
  derived and/or modified sequence opt4 from neuraminidase__InfluenzaA__AGV98980

SEQ ID NO: 176374 - RNA, 1410 nt, Artificial Sequence; identical to SEQ ID NO: 174666
  derived and/or modified sequence opt4 from neuraminidase__InfluenzaA__AGV98993

SEQ ID NO: 176375 - RNA, 1410 nt, Artificial Sequence; identical to SEQ ID NO: 174666
  derived and/or modified sequence opt4 from neuraminidase__InfluenzaA__AGV99005

SEQ ID NO: 176376 - RNA, 1410 nt, Artificial Sequence; identical to SEQ ID NO: 174666
  derived and/or modified sequence opt4 from neuraminidase__InfluenzaA__AGV99017

SEQ ID NO: 176377 - RNA, 1410 nt, Artificial Sequence; identical to SEQ ID NO: 174666
  derived and/or modified sequence opt4 from neuraminidase__InfluenzaA__AGV99040

SEQ ID NO: 176378 - RNA, 1410 nt, Artificial Sequence
  derived and/or modified sequence opt4 from neuraminidase__InfluenzaA__AGV99052
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcgugaucagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176379 - RNA, 1410 nt, Artificial Sequence
  derived and/or modified sequence opt4 from neuraminidase__InfluenzaA__AGV99100
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcgugaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176380 - RNA, 1410 nt, Artificial Sequence; identical to SEQ ID NO: 174666
  derived and/or modified sequence opt4 from neuraminidase__InfluenzaA__AGV99112

SEQ ID NO: 176381 - RNA, 1410 nt, Artificial Sequence; identical to SEQ ID NO: 174666
  derived and/or modified sequence opt4 from neuraminidase__InfluenzaA__AGV99124

SEQ ID NO: 176382 - RNA, 1410 nt, Artificial Sequence; identical to SEQ ID NO: 174666
  derived and/or modified sequence opt4 from neuraminidase__InfluenzaA__AGV99136

SEQ ID NO: 176383 - RNA, 1410 nt, Artificial Sequence; identical to SEQ ID NO: 174666
  derived and/or modified sequence opt4 from neuraminidase__InfluenzaA__AGV99148

SEQ ID NO: 176384 - RNA, 1410 nt, Artificial Sequence; identical to SEQ ID NO: 174666
  derived and/or modified sequence opt4 from neuraminidase__InfluenzaA__AGV99160

SEQ ID NO: 176385 - RNA, 1410 nt, Artificial Sequence; identical to SEQ ID NO: 174666
  derived and/or modified sequence opt4 from neuraminidase__InfluenzaA__AGV99172

SEQ ID NO: 176386 - RNA, 1410 nt, Artificial Sequence; identical to SEQ ID NO: 174666
  derived and/or modified sequence opt4 from neuraminidase__InfluenzaA__AGV99196

SEQ ID NO: 176387 - RNA, 1410 nt, Artificial Sequence; identical to SEQ ID NO: 174666
  derived and/or modified sequence opt4 from neuraminidase__InfluenzaA__AGV99208

SEQ ID NO: 176388 - RNA, 1410 nt, Artificial Sequence; identical to SEQ ID NO: 174666
  derived and/or modified sequence opt4 from neuraminidase__InfluenzaA__AGV99959

SEQ ID NO: 176389 - RNA, 1410 nt, Artificial Sequence; identical to SEQ ID NO: 175877
  derived and/or modified sequence opt4 from neuraminidase__InfluenzaA__AGW00005

SEQ ID NO: 176390 - RNA, 1410 nt, Artificial Sequence; identical to SEQ ID NO: 174666
  derived and/or modified sequence opt4 from neuraminidase__InfluenzaA__AGW00068

SEQ ID NO: 176391 - RNA, 1410 nt, Artificial Sequence
  derived and/or modified sequence opt4 from neuraminidase__InfluenzaA__AGW00080
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176392 - RNA, 1410 nt, Artificial Sequence
  derived and/or modified sequence opt4 from neuraminidase__InfluenzaA__AGW00104
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176393 - RNA, 1410 nt, Artificial Sequence; identical to SEQ ID NO: 176391
  derived and/or modified sequence opt4 from neuraminidase__InfluenzaA__AGW00116

SEQ ID NO: 176394 - RNA, 1410 nt, Artificial Sequence; identical to SEQ ID NO: 176391
  derived and/or modified sequence opt4 from neuraminidase__InfluenzaA__AGW00128

SEQ ID NO: 176395 - RNA, 1410 nt, Artificial Sequence; identical to SEQ ID NO: 174666
  derived and/or modified sequence opt4 from neuraminidase__InfluenzaA__AGW00140

SEQ ID NO: 176396 - RNA, 1410 nt, Artificial Sequence; identical to SEQ ID NO: 174666
  derived and/or modified sequence opt4 from neuraminidase__InfluenzaA__AGW00152

SEQ ID NO: 176397 - RNA, 1410 nt, Artificial Sequence; identical to SEQ ID NO: 176391
  derived and/or modified sequence opt4 from neuraminidase__InfluenzaA__AGW00164

SEQ ID NO: 176398 - RNA, 1410 nt, Artificial Sequence; identical to SEQ ID NO: 174666
  derived and/or modified sequence opt4 from neuraminidase__InfluenzaA__AGW00176

SEQ ID NO: 176399 - RNA, 1410 nt, Artificial Sequence; identical to SEQ ID NO: 174666
  derived and/or modified sequence opt4 from neuraminidase__InfluenzaA__AGW00188

SEQ ID NO: 176400 - RNA, 1410 nt, Artificial Sequence; identical to SEQ ID NO: 174666
  derived and/or modified sequence opt4 from neuraminidase__InfluenzaA__AGW00712

SEQ ID NO: 176401 - RNA, 1410 nt, Artificial Sequence; identical to SEQ ID NO: 174666
  derived and/or modified sequence opt4 from neuraminidase__InfluenzaA__AGW00724

SEQ ID NO: 176402 - RNA, 1410 nt, Artificial Sequence
  derived and/or modified sequence opt4 from neuraminidase__InfluenzaA__AGW00736
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcgaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176403 - RNA, 1410 nt, Artificial Sequence
  derived and/or modified sequence opt4 from neuraminidase__InfluenzaA__AGW00748
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176404 - RNA, 1410 nt, Artificial Sequence
  derived and/or modified sequence opt4 from neuraminidase__InfluenzaA__AGW00760
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcaggugaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176405 - RNA, 1410 nt, Artificial Sequence; identical to SEQ ID NO: 174666
  derived and/or modified sequence opt4 from neuraminidase__InfluenzaA__AGW00784

SEQ ID NO: 176406 - RNA, 1410 nt, Artificial Sequence; identical to SEQ ID NO: 174666
  derived and/or modified sequence opt4 from neuraminidase__InfluenzaA__AGW00796

SEQ ID NO: 176407 - RNA, 1410 nt, Artificial Sequence; identical to SEQ ID NO: 176391
  derived and/or modified sequence opt4 from neuraminidase__InfluenzaA__AGW00808

SEQ ID NO: 176408 - RNA, 1410 nt, Artificial Sequence; identical to SEQ ID NO: 175895
  derived and/or modified sequence opt4 from neuraminidase__InfluenzaA__AGW00820

SEQ ID NO: 176409 - RNA, 1410 nt, Artificial Sequence; identical to SEQ ID NO: 174666
  derived and/or modified sequence opt4 from neuraminidase__InfluenzaA__AGW00832

SEQ ID NO: 176410 - RNA, 1410 nt, Artificial Sequence
  derived and/or modified sequence opt4 from neuraminidase__InfluenzaA__AGW00844
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176411 - RNA, 1410 nt, Artificial Sequence; identical to SEQ ID NO: 176403
  derived and/or modified sequence opt4 from neuraminidase__InfluenzaA__AGW00868

SEQ ID NO: 176412 - RNA, 1410 nt, Artificial Sequence
  derived and/or modified sequence opt4 from neuraminidase__InfluenzaA__AGW00880
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacgugugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccgacgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176413 - RNA, 1410 nt, Artificial Sequence
  derived and/or modified sequence opt4 from neuraminidase__InfluenzaA__AGW00892
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaugaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176414 - RNA, 1410 nt, Artificial Sequence
  derived and/or modified sequence opt4 from neuraminidase__InfluenzaA__AGW00904
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176415 - RNA, 1410 nt, Artificial Sequence
  derived and/or modified sequence opt4 from neuraminidase__InfluenzaA__AGW00916
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugugcgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176416 - RNA, 1410 nt, Artificial Sequence; identical to SEQ ID NO: 176391
  derived and/or modified sequence opt4 from neuraminidase__InfluenzaA__AGW00934

SEQ ID NO: 176417 - RNA, 1410 nt, Artificial Sequence
  derived and/or modified sequence opt4 from neuraminidase__InfluenzaA__AGW01247
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaaggacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176418 - RNA, 1410 nt, Artificial Sequence; identical to SEQ ID NO: 174666
  derived and/or modified sequence opt4 from neuraminidase__InfluenzaA__AGW01259

SEQ ID NO: 176419 - RNA, 1410 nt, Artificial Sequence; identical to SEQ ID NO: 176403
  derived and/or modified sequence opt4 from neuraminidase__InfluenzaA__AGW01298

SEQ ID NO: 176420 - RNA, 1410 nt, Artificial Sequence; identical to SEQ ID NO: 175895
  derived and/or modified sequence opt4 from neuraminidase__InfluenzaA__AGW01322

SEQ ID NO: 176421 - RNA, 1410 nt, Artificial Sequence
  derived and/or modified sequence opt4 from neuraminidase__InfluenzaA__AGW01334
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggaggccgaggugcuguggaccagcaacagcaucgugguguucugcggcaccagcggcaccuacggcaccggcagcuggcccgacggcgccgaccugaaccugaugcccaucuga

SEQ ID NO: 176422 - RNA, 1410 nt, Artificial Sequence; identical to SEQ ID NO: 174666
  derived and/or modified sequence opt4 from neuraminidase__InfluenzaA__AGW01346

SEQ ID NO: 176423 - RNA, 1410 nt, Artificial Sequence
  derived and/or modified sequence opt4 from neuraminidase__InfluenzaA__AGW01358
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccaccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176424 - RNA, 1410 nt, Artificial Sequence; identical to SEQ ID NO: 174666
  derived and/or modified sequence opt4 from neuraminidase__InfluenzaA__AGW01370

SEQ ID NO: 176425 - RNA, 1410 nt, Artificial Sequence; identical to SEQ ID NO: 174666
  derived and/or modified sequence opt4 from neuraminidase__InfluenzaA__AGW01382

SEQ ID NO: 176426 - RNA, 1410 nt, Artificial Sequence
  derived and/or modified sequence opt4 from neuraminidase__InfluenzaA__AGW01394
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176427 - RNA, 1410 nt, Artificial Sequence
  derived and/or modified sequence opt4 from neuraminidase__InfluenzaA__AGW01406
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaucaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176428 - RNA, 1410 nt, Artificial Sequence
  derived and/or modified sequence opt4 from neuraminidase__InfluenzaA__AGW01418
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccggcgugcuguggaccagcaacagcaucgugguguucugcggcaccagcggcaccuacggcaccggcagcuggcccgacggcgccgaccugaaccugaugcccaucuga

SEQ ID NO: 176429 - RNA, 1410 nt, Artificial Sequence; identical to SEQ ID NO: 174666
  derived and/or modified sequence opt4 from neuraminidase__InfluenzaA__AGW01430

SEQ ID NO: 176430 - RNA, 1410 nt, Artificial Sequence; identical to SEQ ID NO: 174666
  derived and/or modified sequence opt4 from neuraminidase__InfluenzaA__AGW01442

SEQ ID NO: 176431 - RNA, 1410 nt, Artificial Sequence; identical to SEQ ID NO: 174666
  derived and/or modified sequence opt4 from neuraminidase__InfluenzaA__AGW01454

SEQ ID NO: 176432 - RNA, 1410 nt, Artificial Sequence; identical to SEQ ID NO: 176391
  derived and/or modified sequence opt4 from neuraminidase__InfluenzaA__AGW01466

SEQ ID NO: 176433 - RNA, 1410 nt, Artificial Sequence; identical to SEQ ID NO: 174666
  derived and/or modified sequence opt4 from neuraminidase__InfluenzaA__AGW01478

SEQ ID NO: 176434 - RNA, 1410 nt, Artificial Sequence
  derived and/or modified sequence opt4 from neuraminidase__InfluenzaA__AGW01490
augaaccccaaccagaagaucaucaccaucagcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaacagcaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176435 - RNA, 1410 nt, Artificial Sequence; identical to SEQ ID NO: 174666
  derived and/or modified sequence opt4 from neuraminidase__InfluenzaA__AGW01538

SEQ ID NO: 176436 - RNA, 1410 nt, Artificial Sequence; identical to SEQ ID NO: 176391
  derived and/or modified sequence opt4 from neuraminidase__InfluenzaA__AGW01562

SEQ ID NO: 176437 - RNA, 1410 nt, Artificial Sequence; identical to SEQ ID NO: 174666
  derived and/or modified sequence opt4 from neuraminidase__InfluenzaA__AGW01574

SEQ ID NO: 176438 - RNA, 1410 nt, Artificial Sequence; identical to SEQ ID NO: 174666
  derived and/or modified sequence opt4 from neuraminidase__InfluenzaA__AGW01586

SEQ ID NO: 176439 - RNA, 1410 nt, Artificial Sequence; identical to SEQ ID NO: 174666
  derived and/or modified sequence opt4 from neuraminidase__InfluenzaA__AGW01598

SEQ ID NO: 176440 - RNA, 1410 nt, Artificial Sequence; identical to SEQ ID NO: 176391
  derived and/or modified sequence opt4 from neuraminidase__InfluenzaA__AGW01610

SEQ ID NO: 176441 - RNA, 1410 nt, Artificial Sequence; identical to SEQ ID NO: 174666
  derived and/or modified sequence opt4 from neuraminidase__InfluenzaA__AGW01622

SEQ ID NO: 176442 - RNA, 1410 nt, Artificial Sequence; identical to SEQ ID NO: 174666
  derived and/or modified sequence opt4 from neuraminidase__InfluenzaA__AGW01634

SEQ ID NO: 176443 - RNA, 1410 nt, Artificial Sequence
  derived and/or modified sequence opt4 from neuraminidase__InfluenzaA__AGW01646
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucgacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176444 - RNA, 1410 nt, Artificial Sequence; identical to SEQ ID NO: 174666
  derived and/or modified sequence opt4 from neuraminidase__InfluenzaA__AGW01670

SEQ ID NO: 176445 - RNA, 1410 nt, Artificial Sequence; identical to SEQ ID NO: 174666
  derived and/or modified sequence opt4 from neuraminidase__InfluenzaA__AGW01682

SEQ ID NO: 176446 - RNA, 1410 nt, Artificial Sequence; identical to SEQ ID NO: 176403
  derived and/or modified sequence opt4 from neuraminidase__InfluenzaA__AGW01704

SEQ ID NO: 176447 - RNA, 1410 nt, Artificial Sequence
  derived and/or modified sequence opt4 from neuraminidase__InfluenzaA__AGW01716
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcagaagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176448 - RNA, 1410 nt, Artificial Sequence
  derived and/or modified sequence opt4 from neuraminidase__InfluenzaA__AGW01728
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcguggugguguucugcggcaccagcggcaccuacggcaccggcagcuggcccgacggcgccgaccugaaccugaugcccaucuga

SEQ ID NO: 176449 - RNA, 1410 nt, Artificial Sequence; identical to SEQ ID NO: 174666
  derived and/or modified sequence opt4 from neuraminidase__InfluenzaA__AGW01740

SEQ ID NO: 176450 - RNA, 1410 nt, Artificial Sequence
  derived and/or modified sequence opt4 from neuraminidase__InfluenzaA__AGW01752
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucggcggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176451 - RNA, 1410 nt, Artificial Sequence; identical to SEQ ID NO: 174666
  derived and/or modified sequence opt4 from neuraminidase__InfluenzaA__AGW01764

SEQ ID NO: 176452 - RNA, 1410 nt, Artificial Sequence; identical to SEQ ID NO: 176403
  derived and/or modified sequence opt4 from neuraminidase__InfluenzaA__AGW01776

SEQ ID NO: 176453 - RNA, 1410 nt, Artificial Sequence; identical to SEQ ID NO: 176391
  derived and/or modified sequence opt4 from neuraminidase__InfluenzaA__AGW01788

SEQ ID NO: 176454 - RNA, 1410 nt, Artificial Sequence; identical to SEQ ID NO: 176403
  derived and/or modified sequence opt4 from neuraminidase__InfluenzaA__AGW01800

SEQ ID NO: 176455 - RNA, 1410 nt, Artificial Sequence; identical to SEQ ID NO: 176391
  derived and/or modified sequence opt4 from neuraminidase__InfluenzaA__AGW01812

SEQ ID NO: 176456 - RNA, 1410 nt, Artificial Sequence; identical to SEQ ID NO: 176391
  derived and/or modified sequence opt4 from neuraminidase__InfluenzaA__AGW01824

SEQ ID NO: 176457 - RNA, 1410 nt, Artificial Sequence; identical to SEQ ID NO: 176414
  derived and/or modified sequence opt4 from neuraminidase__InfluenzaA__AGW01848

SEQ ID NO: 176458 - RNA, 1410 nt, Artificial Sequence
  derived and/or modified sequence opt4 from neuraminidase__InfluenzaA__AGW01860
augaaccccaaccagaagaucaucaccaucggcagcgugagccugaccaucagcaccaucugcuucuucaugcagaucgccauccugaucaccaccgugacccugcacuucaagcaguacgaguucaacagccugcccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugcuucgaccccaacaacgaggagggcggccacggcgugaagggcugggccuucgacgacggcaacgacguguggaugggcagaaccaucaacgagaccagcagacugggcuacgagaccuucaaggugaucggcggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucaucguguucugcggcaccagcggcaccuacggcaccggcagcuggcccgacggcgccgaccugaaccugaugcccaucuga

SEQ ID NO: 176459 - RNA, 1410 nt, Artificial Sequence
  derived and/or modified sequence opt4 from neuraminidase__InfluenzaA__AGW01884
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccaagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176460 - RNA, 1410 nt, Artificial Sequence; identical to SEQ ID NO: 174666
  derived and/or modified sequence opt4 from neuraminidase__InfluenzaA__AGW01896

SEQ ID NO: 176461 - RNA, 1410 nt, Artificial Sequence; identical to SEQ ID NO: 174666
  derived and/or modified sequence opt4 from neuraminidase__InfluenzaA__AGW01908

SEQ ID NO: 176462 - RNA, 1410 nt, Artificial Sequence; identical to SEQ ID NO: 174666
  derived and/or modified sequence opt4 from neuraminidase__InfluenzaA__AGW01920

SEQ ID NO: 176463 - RNA, 1410 nt, Artificial Sequence; identical to SEQ ID NO: 174666
  derived and/or modified sequence opt4 from neuraminidase__InfluenzaA__AGW01932

SEQ ID NO: 176464 - RNA, 1410 nt, Artificial Sequence
  derived and/or modified sequence opt4 from neuraminidase__InfluenzaA__AGW01944
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggcccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176465 - RNA, 1410 nt, Artificial Sequence; identical to SEQ ID NO: 174666
  derived and/or modified sequence opt4 from neuraminidase__InfluenzaA__AGW01956

SEQ ID NO: 176466 - RNA, 1410 nt, Artificial Sequence
  derived and/or modified sequence opt4 from neuraminidase__InfluenzaA__AGW01968
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccaucagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacgagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176467 - RNA, 1410 nt, Artificial Sequence; identical to SEQ ID NO: 176391
  derived and/or modified sequence opt4 from neuraminidase__InfluenzaA__AGW01980

SEQ ID NO: 176468 - RNA, 1410 nt, Artificial Sequence; identical to SEQ ID NO: 174666
  derived and/or modified sequence opt4 from neuraminidase__InfluenzaA__AGW01992

SEQ ID NO: 176469 - RNA, 1410 nt, Artificial Sequence; identical to SEQ ID NO: 174666
  derived and/or modified sequence opt4 from neuraminidase__InfluenzaA__AGW02004

SEQ ID NO: 176470 - RNA, 1410 nt, Artificial Sequence; identical to SEQ ID NO: 174666
  derived and/or modified sequence opt4 from neuraminidase__InfluenzaA__AGW02016

SEQ ID NO: 176471 - RNA, 1410 nt, Artificial Sequence; identical to SEQ ID NO: 174666
  derived and/or modified sequence opt4 from neuraminidase__InfluenzaA__AGW02040

SEQ ID NO: 176472 - RNA, 1410 nt, Artificial Sequence
  derived and/or modified sequence opt4 from neuraminidase__InfluenzaA__AGW02064
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176473 - RNA, 1410 nt, Artificial Sequence; identical to SEQ ID NO: 174666
  derived and/or modified sequence opt4 from neuraminidase__InfluenzaA__AGW02076

SEQ ID NO: 176474 - RNA, 1410 nt, Artificial Sequence; identical to SEQ ID NO: 174666
  derived and/or modified sequence opt4 from neuraminidase__InfluenzaA__AGW02088

SEQ ID NO: 176475 - RNA, 1410 nt, Artificial Sequence
  derived and/or modified sequence opt4 from neuraminidase__InfluenzaA__AGW02100
augaaccccaaccagaagaucaucaccaucggcagcgugagccugaccaucagcaccaucugcuucuucaugcagaucgccauccugaucaccaccgugacccugcacuucaagcaguacgagagcaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176476 - RNA, 1410 nt, Artificial Sequence; identical to SEQ ID NO: 176403
  derived and/or modified sequence opt4 from neuraminidase__InfluenzaA__AGW02112

SEQ ID NO: 176477 - RNA, 1410 nt, Artificial Sequence
  derived and/or modified sequence opt4 from neuraminidase__InfluenzaA__AGW02124
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagcgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176478 - RNA, 1410 nt, Artificial Sequence; identical to SEQ ID NO: 176391
  derived and/or modified sequence opt4 from neuraminidase__InfluenzaA__AGW02136

SEQ ID NO: 176479 - RNA, 1410 nt, Artificial Sequence; identical to SEQ ID NO: 176403
  derived and/or modified sequence opt4 from neuraminidase__InfluenzaA__AGW02148

SEQ ID NO: 176480 - RNA, 1410 nt, Artificial Sequence
  derived and/or modified sequence opt4 from neuraminidase__InfluenzaA__AGW02160
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176481 - RNA, 1410 nt, Artificial Sequence; identical to SEQ ID NO: 174666
  derived and/or modified sequence opt4 from neuraminidase__InfluenzaA__AGW02172

SEQ ID NO: 176482 - RNA, 1410 nt, Artificial Sequence; identical to SEQ ID NO: 174666
  derived and/or modified sequence opt4 from neuraminidase__InfluenzaA__AGW02184

SEQ ID NO: 176483 - RNA, 1410 nt, Artificial Sequence
  derived and/or modified sequence opt4 from neuraminidase__InfluenzaA__AGW02196
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaucaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccuacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176484 - RNA, 1410 nt, Artificial Sequence; identical to SEQ ID NO: 175895
  derived and/or modified sequence opt4 from neuraminidase__InfluenzaA__AGW04174

SEQ ID NO: 176485 - RNA, 1410 nt, Artificial Sequence
  derived and/or modified sequence opt4 from neuraminidase__InfluenzaA__AGW25784
augaaccccaaccagaagaucaucaccaucggcagcgugagccugaucaucgccaccaucugcuuccugaugcagaucgccauccuggugaccaccgugacccugcacuucaagcaguacggcuacaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccuacaagugcuaccaguucgcccugggccagggcaccacccugaacaacaagcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacaucugcgugaccggccacgacgagaacgccaccgccagcuucaucuacgacggcaagcugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcaucagaugcgugugcagagacaacuggaagggcagcaacagacccaucguggacaucaacgugaaggacuacagcaucaccagcagcuacgugugcagcggccuggugggcgacacccccagaaagaccgacaacagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucaagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagagagaggccgaggugugguggaccagcaacagcaucgugguguucugcggcaccagcggcaccuacggcaccggcagcuggcccgacggcgccgacaucaaccugaugcccaucuga

SEQ ID NO: 176486 - RNA, 1350 nt, Artificial Sequence
  derived and/or modified sequence opt4 from neuraminidase__InfluenzaA__AGW27062
augaaccccaaccagaagaucgugaccaucggcagcaucugcauggugaucggcaccaucagccugaugcugcagaucggcaacaucaucagcaucugggugagccacagcauccagaccggcaaccagcaccagaccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccaucggcgaggcccccagccccuacaacagcagauucgagagcguggccuggagcgccagcgccugccacgacggcaccagcuggcuggugaucggcaucagcggccccgacaacggcgccguggccgugcugaaguacaacggcaucaucaccgacaccaucagaagcuggagaaacaacauccugagaacccaggagagcgagugcgccugcgugaacggcagcugcuucaccgugaugaccgacggccccagcaacggccaggccagcuacaagaucuucaagaucgagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcacccacagcagaagcggcuucgagaugaucugggaccccaacggcuggaccggcaccgacagcgaguucagcaugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 176487 - RNA, 1410 nt, Artificial Sequence
  derived and/or modified sequence opt4 from neuraminidase__InfluenzaA__AGY14472
augaaccccaaccagaagaucaucaccaucggcagcgugagccugacccuggccaccaucugcuuccugaugcagaucgccauccuggugaccaccgugacccugcacuucaagcaguacgagugcaacagcacccccaacaaccaggugaugcugugcgagcccaccgugaucgagagaaacaucaccaagaucguguaccugaccaacaccaccguggagaaggagaucugccccaagcccgccgaguacagaaacuggagcaagccccagugcaagaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacagacacagcaacgacaccgugcacgacagaacccccuacagaacccugcugaugaacgagcugggcauccccuuccaccugggcaccaagcaggugugcaucgccuggagcagcagcagcugccacgacggcaaggccuggcugcacgugugcgugaccggccacgacaagaacgccaccgccagcuucaucuacgacggcaagcugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucauccacaucagccagcugagcggcagcgcccagcacguggaggagugcagcugcuaccccagauaccccggcaucagaugcgugugcagagacaacuggaagggcagcaacagacccaucguggacaucaacgugaaggacuacagcaucaccagcagcuacgugugcagcggccuggugggcgacacccccagaaagaccgacaacagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucaagggcuggagcaagcccaacagcaagcugcagaucaacagacaggugaucguggacagagacaacagaagcggcuacagcggcaucuucagcguggagggcaagagcugcaucaacagaugcuucuacguggagcugaucagaggcagaaagagagaggccgaggugugguggaccagcaacagcaucgugguguucugcggcaccagcggcaccuacggcaccggcagcuggcccgacggcgccgacaucaaccugaugcccaucuga

SEQ ID NO: 176488 - RNA, 1398 nt, Artificial Sequence
  derived and/or modified sequence opt4 from neuraminidase__InfluenzaA__AHA11501
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccaucguguucaccgacggcagcgccaccggccccgccgacaccagaaucuacuacuucaaggagggcaagauccuggagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacacccccagacccaacgaccccaacaucggcaagugcaacgaccccuaccccggcaacgacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccagaaucgaguacuuccuguga

SEQ ID NO: 176489 - RNA, 1410 nt, Artificial Sequence
  derived and/or modified sequence opt4 from neuraminidase__InfluenzaA__AHC57462
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugcugggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcaggugaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176490 - RNA, 1410 nt, Artificial Sequence; identical to SEQ ID NO: 172038
  derived and/or modified sequence opt4 from neuraminidase__InfluenzaA__AHC57490

SEQ ID NO: 176491 - RNA, 1410 nt, Artificial Sequence
  derived and/or modified sequence opt4 from neuraminidase__InfluenzaA__AHC57514
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176492 - RNA, 1410 nt, Artificial Sequence; identical to SEQ ID NO: 176491
  derived and/or modified sequence opt4 from neuraminidase__InfluenzaA__AHC57526

SEQ ID NO: 176493 - RNA, 1410 nt, Artificial Sequence; identical to SEQ ID NO: 176491
  derived and/or modified sequence opt4 from neuraminidase__InfluenzaA__AHC57806

SEQ ID NO: 176494 - RNA, 1410 nt, Artificial Sequence; identical to SEQ ID NO: 176491
  derived and/or modified sequence opt4 from neuraminidase__InfluenzaA__AHC57818

SEQ ID NO: 176495 - RNA, 1410 nt, Artificial Sequence
  derived and/or modified sequence opt4 from neuraminidase__InfluenzaA__AHC57830
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176496 - RNA, 1410 nt, Artificial Sequence; identical to SEQ ID NO: 176495
  derived and/or modified sequence opt4 from neuraminidase__InfluenzaA__AHC57971

SEQ ID NO: 176497 - RNA, 1410 nt, Artificial Sequence; identical to SEQ ID NO: 176491
  derived and/or modified sequence opt4 from neuraminidase__InfluenzaA__AHC57984

SEQ ID NO: 176498 - RNA, 1410 nt, Artificial Sequence
  derived and/or modified sequence opt4 from neuraminidase__InfluenzaA__AHC57996
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaaccccccacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176499 - RNA, 1410 nt, Artificial Sequence; identical to SEQ ID NO: 175442
  derived and/or modified sequence opt4 from neuraminidase__InfluenzaA__AHC58008

SEQ ID NO: 176500 - RNA, 1410 nt, Artificial Sequence; identical to SEQ ID NO: 172038
  derived and/or modified sequence opt4 from neuraminidase__InfluenzaA__AHC58020

SEQ ID NO: 176501 - RNA, 1410 nt, Artificial Sequence
  derived and/or modified sequence opt4 from neuraminidase__InfluenzaA__AHC58032
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176502 - RNA, 1410 nt, Artificial Sequence; identical to SEQ ID NO: 175442
  derived and/or modified sequence opt4 from neuraminidase__InfluenzaA__AHC58053

SEQ ID NO: 176503 - RNA, 1410 nt, Artificial Sequence
  derived and/or modified sequence opt4 from neuraminidase__InfluenzaA__AHC58077
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugagagagcccaccaucaucgagagaaacaucaccgagaucguguaccugaccaacaccaccaccgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176504 - RNA, 1410 nt, Artificial Sequence; identical to SEQ ID NO: 176495
  derived and/or modified sequence opt4 from neuraminidase__InfluenzaA__AHC58089

SEQ ID NO: 176505 - RNA, 1410 nt, Artificial Sequence; identical to SEQ ID NO: 176491
  derived and/or modified sequence opt4 from neuraminidase__InfluenzaA__AHC58101

SEQ ID NO: 176506 - RNA, 1410 nt, Artificial Sequence
  derived and/or modified sequence opt4 from neuraminidase__InfluenzaA__AHC58113
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176507 - RNA, 1410 nt, Artificial Sequence; identical to SEQ ID NO: 176491
  derived and/or modified sequence opt4 from neuraminidase__InfluenzaA__AHC58129

SEQ ID NO: 176508 - RNA, 1410 nt, Artificial Sequence; identical to SEQ ID NO: 176491
  derived and/or modified sequence opt4 from neuraminidase__InfluenzaA__AHC58153

SEQ ID NO: 176509 - RNA, 1410 nt, Artificial Sequence; identical to SEQ ID NO: 176491
  derived and/or modified sequence opt4 from neuraminidase__InfluenzaA__AHC58165

SEQ ID NO: 176510 - RNA, 1410 nt, Artificial Sequence; identical to SEQ ID NO: 176495
  derived and/or modified sequence opt4 from neuraminidase__InfluenzaA__AHC58177

SEQ ID NO: 176511 - RNA, 1410 nt, Artificial Sequence
  derived and/or modified sequence opt4 from neuraminidase__InfluenzaA__AHC58189
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaugagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176512 - RNA, 1410 nt, Artificial Sequence; identical to SEQ ID NO: 176491
  derived and/or modified sequence opt4 from neuraminidase__InfluenzaA__AHC58201

SEQ ID NO: 176513 - RNA, 1410 nt, Artificial Sequence
  derived and/or modified sequence opt4 from neuraminidase__InfluenzaA__AHC58225
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugaacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176514 - RNA, 1410 nt, Artificial Sequence; identical to SEQ ID NO: 176495
  derived and/or modified sequence opt4 from neuraminidase__InfluenzaA__AHC58237

SEQ ID NO: 176515 - RNA, 1410 nt, Artificial Sequence; identical to SEQ ID NO: 176491
  derived and/or modified sequence opt4 from neuraminidase__InfluenzaA__AHC58249

SEQ ID NO: 176516 - RNA, 1410 nt, Artificial Sequence; identical to SEQ ID NO: 172038
  derived and/or modified sequence opt4 from neuraminidase__InfluenzaA__AHC58273

SEQ ID NO: 176517 - RNA, 1410 nt, Artificial Sequence; identical to SEQ ID NO: 176495
  derived and/or modified sequence opt4 from neuraminidase__InfluenzaA__AHC58363

SEQ ID NO: 176518 - RNA, 1410 nt, Artificial Sequence; identical to SEQ ID NO: 175442
  derived and/or modified sequence opt4 from neuraminidase__InfluenzaA__AHC58375

SEQ ID NO: 176519 - RNA, 1410 nt, Artificial Sequence; identical to SEQ ID NO: 176495
  derived and/or modified sequence opt4 from neuraminidase__InfluenzaA__AHC58387

SEQ ID NO: 176520 - RNA, 1410 nt, Artificial Sequence; identical to SEQ ID NO: 176495
  derived and/or modified sequence opt4 from neuraminidase__InfluenzaA__AHC58399

SEQ ID NO: 176521 - RNA, 1410 nt, Artificial Sequence; identical to SEQ ID NO: 176491
  derived and/or modified sequence opt4 from neuraminidase__InfluenzaA__AHC58411

SEQ ID NO: 176522 - RNA, 1410 nt, Artificial Sequence; identical to SEQ ID NO: 175442
  derived and/or modified sequence opt4 from neuraminidase__InfluenzaA__AHC58423

SEQ ID NO: 176523 - RNA, 1410 nt, Artificial Sequence; identical to SEQ ID NO: 176495
  derived and/or modified sequence opt4 from neuraminidase__InfluenzaA__AHC58459

SEQ ID NO: 176524 - RNA, 1410 nt, Artificial Sequence
  derived and/or modified sequence opt4 from neuraminidase__InfluenzaA__AHC58471
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagcccguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcgccaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176525 - RNA, 1410 nt, Artificial Sequence; identical to SEQ ID NO: 176491
  derived and/or modified sequence opt4 from neuraminidase__InfluenzaA__AHC58482

SEQ ID NO: 176526 - RNA, 1410 nt, Artificial Sequence; identical to SEQ ID NO: 176495
  derived and/or modified sequence opt4 from neuraminidase__InfluenzaA__AHC58494

SEQ ID NO: 176527 - RNA, 1410 nt, Artificial Sequence
  derived and/or modified sequence opt4 from neuraminidase__InfluenzaA__AHC58518
augaaccccaaccagaagaucaucaccaucggcagcgugagccugaccaucagcaccaucugcuucuucaugcagguggccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176528 - RNA, 1410 nt, Artificial Sequence; identical to SEQ ID NO: 176491
  derived and/or modified sequence opt4 from neuraminidase__InfluenzaA__AHC58530

SEQ ID NO: 176529 - RNA, 1410 nt, Artificial Sequence; identical to SEQ ID NO: 176491
  derived and/or modified sequence opt4 from neuraminidase__InfluenzaA__AHC58554

SEQ ID NO: 176530 - RNA, 1410 nt, Artificial Sequence; identical to SEQ ID NO: 176491
  derived and/or modified sequence opt4 from neuraminidase__InfluenzaA__AHC58566

SEQ ID NO: 176531 - RNA, 1410 nt, Artificial Sequence
  derived and/or modified sequence opt4 from neuraminidase__InfluenzaA__AHC58578
augaaccccaaccagaagaucaucaccaucggcagcgugagccugaccgugagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176532 - RNA, 1410 nt, Artificial Sequence; identical to SEQ ID NO: 172038
  derived and/or modified sequence opt4 from neuraminidase__InfluenzaA__AHC58590

SEQ ID NO: 176533 - RNA, 1410 nt, Artificial Sequence; identical to SEQ ID NO: 176527
  derived and/or modified sequence opt4 from neuraminidase__InfluenzaA__AHC58602

SEQ ID NO: 176534 - RNA, 1410 nt, Artificial Sequence; identical to SEQ ID NO: 176491
  derived and/or modified sequence opt4 from neuraminidase__InfluenzaA__AHC58614

SEQ ID NO: 176535 - RNA, 1410 nt, Artificial Sequence; identical to SEQ ID NO: 176491
  derived and/or modified sequence opt4 from neuraminidase__InfluenzaA__AHC58626

SEQ ID NO: 176536 - RNA, 1410 nt, Artificial Sequence; identical to SEQ ID NO: 176491
  derived and/or modified sequence opt4 from neuraminidase__InfluenzaA__AHC58638

SEQ ID NO: 176537 - RNA, 1410 nt, Artificial Sequence; identical to SEQ ID NO: 176491
  derived and/or modified sequence opt4 from neuraminidase__InfluenzaA__AHC58650

SEQ ID NO: 176538 - RNA, 1410 nt, Artificial Sequence
  derived and/or modified sequence opt4 from neuraminidase__InfluenzaA__AHC58662
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176539 - RNA, 1410 nt, Artificial Sequence
  derived and/or modified sequence opt4 from neuraminidase__InfluenzaA__AHC58686
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176540 - RNA, 1410 nt, Artificial Sequence
  derived and/or modified sequence opt4 from neuraminidase__InfluenzaA__AHC58698
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176541 - RNA, 1410 nt, Artificial Sequence; identical to SEQ ID NO: 175442
  derived and/or modified sequence opt4 from neuraminidase__InfluenzaA__AHC58710

SEQ ID NO: 176542 - RNA, 1410 nt, Artificial Sequence; identical to SEQ ID NO: 175442
  derived and/or modified sequence opt4 from neuraminidase__InfluenzaA__AHC58722

SEQ ID NO: 176543 - RNA, 1410 nt, Artificial Sequence
  derived and/or modified sequence opt4 from neuraminidase__InfluenzaA__AHC58734
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcaucagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176544 - RNA, 1410 nt, Artificial Sequence; identical to SEQ ID NO: 176491
  derived and/or modified sequence opt4 from neuraminidase__InfluenzaA__AHC58746

SEQ ID NO: 176545 - RNA, 1410 nt, Artificial Sequence; identical to SEQ ID NO: 176495
  derived and/or modified sequence opt4 from neuraminidase__InfluenzaA__AHC58758

SEQ ID NO: 176546 - RNA, 1410 nt, Artificial Sequence; identical to SEQ ID NO: 176491
  derived and/or modified sequence opt4 from neuraminidase__InfluenzaA__AHC58770

SEQ ID NO: 176547 - RNA, 1410 nt, Artificial Sequence; identical to SEQ ID NO: 172038
  derived and/or modified sequence opt4 from neuraminidase__InfluenzaA__AHC58782

SEQ ID NO: 176548 - RNA, 1410 nt, Artificial Sequence; identical to SEQ ID NO: 176491
  derived and/or modified sequence opt4 from neuraminidase__InfluenzaA__AHC58806

SEQ ID NO: 176549 - RNA, 1410 nt, Artificial Sequence
  derived and/or modified sequence opt4 from neuraminidase__InfluenzaA__AHC58818
augaaccccaaccagaagaucaucaccaucggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176550 - RNA, 1410 nt, Artificial Sequence; identical to SEQ ID NO: 176540
  derived and/or modified sequence opt4 from neuraminidase__InfluenzaA__AHC58830

SEQ ID NO: 176551 - RNA, 1410 nt, Artificial Sequence; identical to SEQ ID NO: 176491
  derived and/or modified sequence opt4 from neuraminidase__InfluenzaA__AHC58842

SEQ ID NO: 176552 - RNA, 1410 nt, Artificial Sequence
  derived and/or modified sequence opt4 from neuraminidase__InfluenzaA__AHC58866
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaacagagugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccggcgugcuguggaccagcaacagcaucgugguguucugcggcaccagcggcaccuacggcaccggcagcuggcccgacggcgccgaccugaaccugaugcccaucuga

SEQ ID NO: 176553 - RNA, 1410 nt, Artificial Sequence; identical to SEQ ID NO: 176540
  derived and/or modified sequence opt4 from neuraminidase__InfluenzaA__AHC58878

SEQ ID NO: 176554 - RNA, 1410 nt, Artificial Sequence; identical to SEQ ID NO: 176491
  derived and/or modified sequence opt4 from neuraminidase__InfluenzaA__AHC58890

SEQ ID NO: 176555 - RNA, 1410 nt, Artificial Sequence; identical to SEQ ID NO: 176495
  derived and/or modified sequence opt4 from neuraminidase__InfluenzaA__AHC58902

SEQ ID NO: 176556 - RNA, 1410 nt, Artificial Sequence; identical to SEQ ID NO: 176491
  derived and/or modified sequence opt4 from neuraminidase__InfluenzaA__AHC58996

SEQ ID NO: 176557 - RNA, 1410 nt, Artificial Sequence; identical to SEQ ID NO: 176491
  derived and/or modified sequence opt4 from neuraminidase__InfluenzaA__AHC59008

SEQ ID NO: 176558 - RNA, 1410 nt, Artificial Sequence; identical to SEQ ID NO: 176495
  derived and/or modified sequence opt4 from neuraminidase__InfluenzaA__AHC59020

SEQ ID NO: 176559 - RNA, 1410 nt, Artificial Sequence
  derived and/or modified sequence opt4 from neuraminidase__InfluenzaA__AHC59032
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccagcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176560 - RNA, 1410 nt, Artificial Sequence; identical to SEQ ID NO: 176527
  derived and/or modified sequence opt4 from neuraminidase__InfluenzaA__AHC59044

SEQ ID NO: 176561 - RNA, 1410 nt, Artificial Sequence; identical to SEQ ID NO: 172038
  derived and/or modified sequence opt4 from neuraminidase__InfluenzaA__AHC59056

SEQ ID NO: 176562 - RNA, 1410 nt, Artificial Sequence; identical to SEQ ID NO: 176491
  derived and/or modified sequence opt4 from neuraminidase__InfluenzaA__AHC59068

SEQ ID NO: 176563 - RNA, 1410 nt, Artificial Sequence; identical to SEQ ID NO: 176491
  derived and/or modified sequence opt4 from neuraminidase__InfluenzaA__AHC59080

SEQ ID NO: 176564 - RNA, 1410 nt, Artificial Sequence
  derived and/or modified sequence opt4 from neuraminidase__InfluenzaA__AHC59092
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176565 - RNA, 1410 nt, Artificial Sequence
  derived and/or modified sequence opt4 from neuraminidase__InfluenzaA__AHC59104
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucaagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176566 - RNA, 1410 nt, Artificial Sequence
  derived and/or modified sequence opt4 from neuraminidase__InfluenzaA__AHC59116
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagagaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176567 - RNA, 1410 nt, Artificial Sequence
  derived and/or modified sequence opt4 from neuraminidase__InfluenzaA__AHC59128
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucauggagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176568 - RNA, 1410 nt, Artificial Sequence
  derived and/or modified sequence opt4 from neuraminidase__InfluenzaA__AHC59152
augaaccccaaccagaagaucaucaccaucggcagcgugagccugaccaucagcaccaucugcuucuucaugcagguggccauccugaucaccaccgugacccugcacuucaagcaguacgaguucaacagcccccccaacaaccaggugaugcugugcgagcccaccaucaucgagagaaacaucaccgagauccuguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176569 - RNA, 1410 nt, Artificial Sequence
  derived and/or modified sequence opt4 from neuraminidase__InfluenzaA__AHC59188
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccagguggugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176570 - RNA, 1410 nt, Artificial Sequence; identical to SEQ ID NO: 172038
  derived and/or modified sequence opt4 from neuraminidase__InfluenzaA__AHC59200

SEQ ID NO: 176571 - RNA, 1410 nt, Artificial Sequence
  derived and/or modified sequence opt4 from neuraminidase__InfluenzaA__AHC59212
augaaccccaaccagaagaucaucaccaucggcagcgugagccugaccaucagcaccaucugcuucuucaugcagaucgccacccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176572 - RNA, 1410 nt, Artificial Sequence; identical to SEQ ID NO: 176495
  derived and/or modified sequence opt4 from neuraminidase__InfluenzaA__AHC59224

SEQ ID NO: 176573 - RNA, 1410 nt, Artificial Sequence
  derived and/or modified sequence opt4 from neuraminidase__InfluenzaA__AHC59236
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176574 - RNA, 1410 nt, Artificial Sequence; identical to SEQ ID NO: 176495
  derived and/or modified sequence opt4 from neuraminidase__InfluenzaA__AHC59260

SEQ ID NO: 176575 - RNA, 1410 nt, Artificial Sequence; identical to SEQ ID NO: 176491
  derived and/or modified sequence opt4 from neuraminidase__InfluenzaA__AHC59272

SEQ ID NO: 176576 - RNA, 1410 nt, Artificial Sequence; identical to SEQ ID NO: 176495
  derived and/or modified sequence opt4 from neuraminidase__InfluenzaA__AHC59284

SEQ ID NO: 176577 - RNA, 1410 nt, Artificial Sequence
  derived and/or modified sequence opt4 from neuraminidase__InfluenzaA__AHC59296
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaagaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176578 - RNA, 1410 nt, Artificial Sequence
  derived and/or modified sequence opt4 from neuraminidase__InfluenzaA__AHC59308
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaugguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176579 - RNA, 1410 nt, Artificial Sequence; identical to SEQ ID NO: 176403
  derived and/or modified sequence opt4 from neuraminidase__InfluenzaA__AHC59320

SEQ ID NO: 176580 - RNA, 1410 nt, Artificial Sequence; identical to SEQ ID NO: 174666
  derived and/or modified sequence opt4 from neuraminidase__InfluenzaA__AHC59332

SEQ ID NO: 176581 - RNA, 1410 nt, Artificial Sequence; identical to SEQ ID NO: 176539
  derived and/or modified sequence opt4 from neuraminidase__InfluenzaA__AHC59344

SEQ ID NO: 176582 - RNA, 1410 nt, Artificial Sequence
  derived and/or modified sequence opt4 from neuraminidase__InfluenzaA__AHC59368
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucgacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176583 - RNA, 1410 nt, Artificial Sequence; identical to SEQ ID NO: 176491
  derived and/or modified sequence opt4 from neuraminidase__InfluenzaA__AHC59380

SEQ ID NO: 176584 - RNA, 1410 nt, Artificial Sequence; identical to SEQ ID NO: 175442
  derived and/or modified sequence opt4 from neuraminidase__InfluenzaA__AHC59392

SEQ ID NO: 176585 - RNA, 1410 nt, Artificial Sequence; identical to SEQ ID NO: 176527
  derived and/or modified sequence opt4 from neuraminidase__InfluenzaA__AHC59404

SEQ ID NO: 176586 - RNA, 1410 nt, Artificial Sequence; identical to SEQ ID NO: 176495
  derived and/or modified sequence opt4 from neuraminidase__InfluenzaA__AHC59416

SEQ ID NO: 176587 - RNA, 1410 nt, Artificial Sequence
  derived and/or modified sequence opt4 from neuraminidase__InfluenzaA__AHC59428
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacagaugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176588 - RNA, 1410 nt, Artificial Sequence
  derived and/or modified sequence opt4 from neuraminidase__InfluenzaA__AHC59440
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcagaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176589 - RNA, 1410 nt, Artificial Sequence; identical to SEQ ID NO: 176495
  derived and/or modified sequence opt4 from neuraminidase__InfluenzaA__AHC59452

SEQ ID NO: 176590 - RNA, 1410 nt, Artificial Sequence; identical to SEQ ID NO: 172038
  derived and/or modified sequence opt4 from neuraminidase__InfluenzaA__AHC59464

SEQ ID NO: 176591 - RNA, 1410 nt, Artificial Sequence; identical to SEQ ID NO: 176403
  derived and/or modified sequence opt4 from neuraminidase__InfluenzaA__AHC59476

SEQ ID NO: 176592 - RNA, 1410 nt, Artificial Sequence; identical to SEQ ID NO: 176495
  derived and/or modified sequence opt4 from neuraminidase__InfluenzaA__AHC59488

SEQ ID NO: 176593 - RNA, 1410 nt, Artificial Sequence; identical to SEQ ID NO: 176495
  derived and/or modified sequence opt4 from neuraminidase__InfluenzaA__AHC59500

SEQ ID NO: 176594 - RNA, 1410 nt, Artificial Sequence; identical to SEQ ID NO: 176540
  derived and/or modified sequence opt4 from neuraminidase__InfluenzaA__AHC59512

SEQ ID NO: 176595 - RNA, 1410 nt, Artificial Sequence; identical to SEQ ID NO: 176540
  derived and/or modified sequence opt4 from neuraminidase__InfluenzaA__AHC59524

SEQ ID NO: 176596 - RNA, 1410 nt, Artificial Sequence; identical to SEQ ID NO: 176527
  derived and/or modified sequence opt4 from neuraminidase__InfluenzaA__AHC59536

SEQ ID NO: 176597 - RNA, 1410 nt, Artificial Sequence; identical to SEQ ID NO: 176495
  derived and/or modified sequence opt4 from neuraminidase__InfluenzaA__AHC59548

SEQ ID NO: 176598 - RNA, 1410 nt, Artificial Sequence; identical to SEQ ID NO: 176495
  derived and/or modified sequence opt4 from neuraminidase__InfluenzaA__AHC59560

SEQ ID NO: 176599 - RNA, 1410 nt, Artificial Sequence; identical to SEQ ID NO: 176573
  derived and/or modified sequence opt4 from neuraminidase__InfluenzaA__AHC59572

SEQ ID NO: 176600 - RNA, 1410 nt, Artificial Sequence; identical to SEQ ID NO: 176568
  derived and/or modified sequence opt4 from neuraminidase__InfluenzaA__AHC59584

SEQ ID NO: 176601 - RNA, 1410 nt, Artificial Sequence; identical to SEQ ID NO: 176540
  derived and/or modified sequence opt4 from neuraminidase__InfluenzaA__AHC59596

SEQ ID NO: 176602 - RNA, 1410 nt, Artificial Sequence; identical to SEQ ID NO: 175442
  derived and/or modified sequence opt4 from neuraminidase__InfluenzaA__AHC59608

SEQ ID NO: 176603 - RNA, 1410 nt, Artificial Sequence; identical to SEQ ID NO: 176527
  derived and/or modified sequence opt4 from neuraminidase__InfluenzaA__AHC59620

SEQ ID NO: 176604 - RNA, 1410 nt, Artificial Sequence; identical to SEQ ID NO: 176495
  derived and/or modified sequence opt4 from neuraminidase__InfluenzaA__AHC59632

SEQ ID NO: 176605 - RNA, 1410 nt, Artificial Sequence; identical to SEQ ID NO: 176495
  derived and/or modified sequence opt4 from neuraminidase__InfluenzaA__AHC59644

SEQ ID NO: 176606 - RNA, 1410 nt, Artificial Sequence
  derived and/or modified sequence opt4 from neuraminidase__InfluenzaA__AHC59656
augaaccccaaccagaagaucaucaccaucggcagcgugagccugaccaucagcaccaucugcuucuucaugcagaucgccauccugaucaccaccgugaccaugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgugaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176607 - RNA, 1410 nt, Artificial Sequence; identical to SEQ ID NO: 176540
  derived and/or modified sequence opt4 from neuraminidase__InfluenzaA__AHC59668

SEQ ID NO: 176608 - RNA, 1410 nt, Artificial Sequence; identical to SEQ ID NO: 176568
  derived and/or modified sequence opt4 from neuraminidase__InfluenzaA__AHC59680

SEQ ID NO: 176609 - RNA, 1410 nt, Artificial Sequence; identical to SEQ ID NO: 176495
  derived and/or modified sequence opt4 from neuraminidase__InfluenzaA__AHC59704

SEQ ID NO: 176610 - RNA, 1410 nt, Artificial Sequence; identical to SEQ ID NO: 172038
  derived and/or modified sequence opt4 from neuraminidase__InfluenzaA__AHC59716

SEQ ID NO: 176611 - RNA, 1410 nt, Artificial Sequence; identical to SEQ ID NO: 172038
  derived and/or modified sequence opt4 from neuraminidase__InfluenzaA__AHC59728

SEQ ID NO: 176612 - RNA, 1410 nt, Artificial Sequence; identical to SEQ ID NO: 176540
  derived and/or modified sequence opt4 from neuraminidase__InfluenzaA__AHC59752

SEQ ID NO: 176613 - RNA, 1410 nt, Artificial Sequence; identical to SEQ ID NO: 176527
  derived and/or modified sequence opt4 from neuraminidase__InfluenzaA__AHC59764

SEQ ID NO: 176614 - RNA, 1410 nt, Artificial Sequence
  derived and/or modified sequence opt4 from neuraminidase__InfluenzaA__AHC59776
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176615 - RNA, 1410 nt, Artificial Sequence; identical to SEQ ID NO: 176491
  derived and/or modified sequence opt4 from neuraminidase__InfluenzaA__AHC59788

SEQ ID NO: 176616 - RNA, 1410 nt, Artificial Sequence; identical to SEQ ID NO: 176568
  derived and/or modified sequence opt4 from neuraminidase__InfluenzaA__AHC59800

SEQ ID NO: 176617 - RNA, 1410 nt, Artificial Sequence
  derived and/or modified sequence opt4 from neuraminidase__InfluenzaA__AHC59812
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucguguacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176618 - RNA, 1410 nt, Artificial Sequence
  derived and/or modified sequence opt4 from neuraminidase__InfluenzaA__AHC59824
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176619 - RNA, 1410 nt, Artificial Sequence; identical to SEQ ID NO: 176495
  derived and/or modified sequence opt4 from neuraminidase__InfluenzaA__AHC59836

SEQ ID NO: 176620 - RNA, 1410 nt, Artificial Sequence; identical to SEQ ID NO: 175442
  derived and/or modified sequence opt4 from neuraminidase__InfluenzaA__AHC59848

SEQ ID NO: 176621 - RNA, 1410 nt, Artificial Sequence; identical to SEQ ID NO: 176491
  derived and/or modified sequence opt4 from neuraminidase__InfluenzaA__AHC59860

SEQ ID NO: 176622 - RNA, 1410 nt, Artificial Sequence; identical to SEQ ID NO: 176538
  derived and/or modified sequence opt4 from neuraminidase__InfluenzaA__AHC59872

SEQ ID NO: 176623 - RNA, 1410 nt, Artificial Sequence; identical to SEQ ID NO: 176527
  derived and/or modified sequence opt4 from neuraminidase__InfluenzaA__AHC59884

SEQ ID NO: 176624 - RNA, 1410 nt, Artificial Sequence
  derived and/or modified sequence opt4 from neuraminidase__InfluenzaA__AHC59895
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176625 - RNA, 1410 nt, Artificial Sequence; identical to SEQ ID NO: 176495
  derived and/or modified sequence opt4 from neuraminidase__InfluenzaA__AHC59907

SEQ ID NO: 176626 - RNA, 1410 nt, Artificial Sequence
  derived and/or modified sequence opt4 from neuraminidase__InfluenzaA__AHC59918
augaaccccaaccagaagaucaucaccaucggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaugaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176627 - RNA, 1410 nt, Artificial Sequence; identical to SEQ ID NO: 176626
  derived and/or modified sequence opt4 from neuraminidase__InfluenzaA__AHC59930

SEQ ID NO: 176628 - RNA, 1410 nt, Artificial Sequence; identical to SEQ ID NO: 176495
  derived and/or modified sequence opt4 from neuraminidase__InfluenzaA__AHC59942

SEQ ID NO: 176629 - RNA, 1410 nt, Artificial Sequence; identical to SEQ ID NO: 176540
  derived and/or modified sequence opt4 from neuraminidase__InfluenzaA__AHC59954

SEQ ID NO: 176630 - RNA, 1410 nt, Artificial Sequence
  derived and/or modified sequence opt4 from neuraminidase__InfluenzaA__AHC59966
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacggcagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176631 - RNA, 1410 nt, Artificial Sequence; identical to SEQ ID NO: 175442
  derived and/or modified sequence opt4 from neuraminidase__InfluenzaA__AHC59978

SEQ ID NO: 176632 - RNA, 1410 nt, Artificial Sequence; identical to SEQ ID NO: 173404
  derived and/or modified sequence opt4 from neuraminidase__InfluenzaA__AHC59990

SEQ ID NO: 176633 - RNA, 1410 nt, Artificial Sequence; identical to SEQ ID NO: 176540
  derived and/or modified sequence opt4 from neuraminidase__InfluenzaA__AHC60002

SEQ ID NO: 176634 - RNA, 1410 nt, Artificial Sequence; identical to SEQ ID NO: 176495
  derived and/or modified sequence opt4 from neuraminidase__InfluenzaA__AHC60014

SEQ ID NO: 176635 - RNA, 1410 nt, Artificial Sequence; identical to SEQ ID NO: 172038
  derived and/or modified sequence opt4 from neuraminidase__InfluenzaA__AHC60026

SEQ ID NO: 176636 - RNA, 1410 nt, Artificial Sequence; identical to SEQ ID NO: 176491
  derived and/or modified sequence opt4 from neuraminidase__InfluenzaA__AHC60038

SEQ ID NO: 176637 - RNA, 1410 nt, Artificial Sequence; identical to SEQ ID NO: 176491
  derived and/or modified sequence opt4 from neuraminidase__InfluenzaA__AHC60050

SEQ ID NO: 176638 - RNA, 1410 nt, Artificial Sequence
  derived and/or modified sequence opt4 from neuraminidase__InfluenzaA__AHC60062
augaaccccaaccagaagaucaucaccaucggcagcgugagccugaccaucagcaccaucugcuucuucaugcagaucgccauccugaucaccaccgugaccaugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176639 - RNA, 1410 nt, Artificial Sequence; identical to SEQ ID NO: 175442
  derived and/or modified sequence opt4 from neuraminidase__InfluenzaA__AHC60074

SEQ ID NO: 176640 - RNA, 1410 nt, Artificial Sequence; identical to SEQ ID NO: 176495
  derived and/or modified sequence opt4 from neuraminidase__InfluenzaA__AHC60086

SEQ ID NO: 176641 - RNA, 1410 nt, Artificial Sequence
  derived and/or modified sequence opt4 from neuraminidase__InfluenzaA__AHC60098
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucgacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176642 - RNA, 1410 nt, Artificial Sequence; identical to SEQ ID NO: 176491
  derived and/or modified sequence opt4 from neuraminidase__InfluenzaA__AHC60110

SEQ ID NO: 176643 - RNA, 1410 nt, Artificial Sequence; identical to SEQ ID NO: 176568
  derived and/or modified sequence opt4 from neuraminidase__InfluenzaA__AHC60122

SEQ ID NO: 176644 - RNA, 1410 nt, Artificial Sequence; identical to SEQ ID NO: 176495
  derived and/or modified sequence opt4 from neuraminidase__InfluenzaA__AHC60134

SEQ ID NO: 176645 - RNA, 1410 nt, Artificial Sequence; identical to SEQ ID NO: 176549
  derived and/or modified sequence opt4 from neuraminidase__InfluenzaA__AHC60146

SEQ ID NO: 176646 - RNA, 1410 nt, Artificial Sequence; identical to SEQ ID NO: 176626
  derived and/or modified sequence opt4 from neuraminidase__InfluenzaA__AHC60158

SEQ ID NO: 176647 - RNA, 1410 nt, Artificial Sequence; identical to SEQ ID NO: 176491
  derived and/or modified sequence opt4 from neuraminidase__InfluenzaA__AHC60182

SEQ ID NO: 176648 - RNA, 1410 nt, Artificial Sequence
  derived and/or modified sequence opt4 from neuraminidase__InfluenzaA__AHC60206
augaaccccaaccagaagaucaucaccaucggcagcgugagccugaccaucagcaucaucugcuucuucaugcagguggccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176649 - RNA, 1410 nt, Artificial Sequence; identical to SEQ ID NO: 175442
  derived and/or modified sequence opt4 from neuraminidase__InfluenzaA__AHC60218

SEQ ID NO: 176650 - RNA, 1410 nt, Artificial Sequence; identical to SEQ ID NO: 172038
  derived and/or modified sequence opt4 from neuraminidase__InfluenzaA__AHC60230

SEQ ID NO: 176651 - RNA, 1410 nt, Artificial Sequence; identical to SEQ ID NO: 176491
  derived and/or modified sequence opt4 from neuraminidase__InfluenzaA__AHC60242

SEQ ID NO: 176652 - RNA, 1410 nt, Artificial Sequence; identical to SEQ ID NO: 176491
  derived and/or modified sequence opt4 from neuraminidase__InfluenzaA__AHC60254

SEQ ID NO: 176653 - RNA, 1410 nt, Artificial Sequence; identical to SEQ ID NO: 176491
  derived and/or modified sequence opt4 from neuraminidase__InfluenzaA__AHC60266

SEQ ID NO: 176654 - RNA, 1410 nt, Artificial Sequence; identical to SEQ ID NO: 176540
  derived and/or modified sequence opt4 from neuraminidase__InfluenzaA__AHC60278

SEQ ID NO: 176655 - RNA, 1410 nt, Artificial Sequence; identical to SEQ ID NO: 176491
  derived and/or modified sequence opt4 from neuraminidase__InfluenzaA__AHC60290

SEQ ID NO: 176656 - RNA, 1410 nt, Artificial Sequence
  derived and/or modified sequence opt4 from neuraminidase__InfluenzaA__AHC60302
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176657 - RNA, 1410 nt, Artificial Sequence; identical to SEQ ID NO: 176491
  derived and/or modified sequence opt4 from neuraminidase__InfluenzaA__AHC60314

SEQ ID NO: 176658 - RNA, 1410 nt, Artificial Sequence; identical to SEQ ID NO: 176491
  derived and/or modified sequence opt4 from neuraminidase__InfluenzaA__AHC60326

SEQ ID NO: 176659 - RNA, 1410 nt, Artificial Sequence
  derived and/or modified sequence opt4 from neuraminidase__InfluenzaA__AHC60338
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcgacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176660 - RNA, 1410 nt, Artificial Sequence; identical to SEQ ID NO: 173404
  derived and/or modified sequence opt4 from neuraminidase__InfluenzaA__AHC60350

SEQ ID NO: 176661 - RNA, 1410 nt, Artificial Sequence
  derived and/or modified sequence opt4 from neuraminidase__InfluenzaA__AHC60362
augaaccccaaccagaagaucaucaccaucggcagcgugagccugaccaucagcaccaucugcuucuucaugcagguggccauccugaucaccaccgugacccugcacuucaagcaguacgaguucaacagcccccccaacaaccaggugaugcugugcaagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176662 - RNA, 1410 nt, Artificial Sequence; identical to SEQ ID NO: 176403
  derived and/or modified sequence opt4 from neuraminidase__InfluenzaA__AHC60374

SEQ ID NO: 176663 - RNA, 1410 nt, Artificial Sequence; identical to SEQ ID NO: 172038
  derived and/or modified sequence opt4 from neuraminidase__InfluenzaA__AHC60386

SEQ ID NO: 176664 - RNA, 1410 nt, Artificial Sequence; identical to SEQ ID NO: 176495
  derived and/or modified sequence opt4 from neuraminidase__InfluenzaA__AHC60398

SEQ ID NO: 176665 - RNA, 1410 nt, Artificial Sequence; identical to SEQ ID NO: 176527
  derived and/or modified sequence opt4 from neuraminidase__InfluenzaA__AHC60410

SEQ ID NO: 176666 - RNA, 1410 nt, Artificial Sequence; identical to SEQ ID NO: 172038
  derived and/or modified sequence opt4 from neuraminidase__InfluenzaA__AHC60422

SEQ ID NO: 176667 - RNA, 1410 nt, Artificial Sequence; identical to SEQ ID NO: 176527
  derived and/or modified sequence opt4 from neuraminidase__InfluenzaA__AHC60434

SEQ ID NO: 176668 - RNA, 1410 nt, Artificial Sequence; identical to SEQ ID NO: 176495
  derived and/or modified sequence opt4 from neuraminidase__InfluenzaA__AHC60446

SEQ ID NO: 176669 - RNA, 1410 nt, Artificial Sequence
  derived and/or modified sequence opt4 from neuraminidase__InfluenzaA__AHC60458
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacggcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176670 - RNA, 1410 nt, Artificial Sequence; identical to SEQ ID NO: 176540
  derived and/or modified sequence opt4 from neuraminidase__InfluenzaA__AHC60470

SEQ ID NO: 176671 - RNA, 1410 nt, Artificial Sequence
  derived and/or modified sequence opt4 from neuraminidase__InfluenzaA__AHC60482
augaaccccaaccagaagaucaucaccaucggcagcgugagccugaccaucagcaccaucugcuucuucaugcagaucgccauccugaccaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176672 - RNA, 1410 nt, Artificial Sequence; identical to SEQ ID NO: 176491
  derived and/or modified sequence opt4 from neuraminidase__InfluenzaA__AHC60494

SEQ ID NO: 176673 - RNA, 1410 nt, Artificial Sequence; identical to SEQ ID NO: 176491
  derived and/or modified sequence opt4 from neuraminidase__InfluenzaA__AHC60506

SEQ ID NO: 176674 - RNA, 1410 nt, Artificial Sequence; identical to SEQ ID NO: 176495
  derived and/or modified sequence opt4 from neuraminidase__InfluenzaA__AHC60518

SEQ ID NO: 176675 - RNA, 1410 nt, Artificial Sequence; identical to SEQ ID NO: 176495
  derived and/or modified sequence opt4 from neuraminidase__InfluenzaA__AHC60542

SEQ ID NO: 176676 - RNA, 1410 nt, Artificial Sequence
  derived and/or modified sequence opt4 from neuraminidase__InfluenzaA__AHC60554
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaugaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcaccuggcccgacggcgccgaccugaaccugaugcccaucuga

SEQ ID NO: 176677 - RNA, 1410 nt, Artificial Sequence
  derived and/or modified sequence opt4 from neuraminidase__InfluenzaA__AHC60566
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcaggugaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176678 - RNA, 1410 nt, Artificial Sequence; identical to SEQ ID NO: 175442
  derived and/or modified sequence opt4 from neuraminidase__InfluenzaA__AHC60578

SEQ ID NO: 176679 - RNA, 1410 nt, Artificial Sequence; identical to SEQ ID NO: 176491
  derived and/or modified sequence opt4 from neuraminidase__InfluenzaA__AHC60590

SEQ ID NO: 176680 - RNA, 1410 nt, Artificial Sequence
  derived and/or modified sequence opt4 from neuraminidase__InfluenzaA__AHC60602
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccagguggugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176681 - RNA, 1410 nt, Artificial Sequence; identical to SEQ ID NO: 172038
  derived and/or modified sequence opt4 from neuraminidase__InfluenzaA__AHC60614

SEQ ID NO: 176682 - RNA, 1410 nt, Artificial Sequence; identical to SEQ ID NO: 175442
  derived and/or modified sequence opt4 from neuraminidase__InfluenzaA__AHC60626

SEQ ID NO: 176683 - RNA, 1410 nt, Artificial Sequence
  derived and/or modified sequence opt4 from neuraminidase__InfluenzaA__AHC60650
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacgagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176684 - RNA, 1410 nt, Artificial Sequence; identical to SEQ ID NO: 176540
  derived and/or modified sequence opt4 from neuraminidase__InfluenzaA__AHC60662

SEQ ID NO: 176685 - RNA, 1410 nt, Artificial Sequence; identical to SEQ ID NO: 176495
  derived and/or modified sequence opt4 from neuraminidase__InfluenzaA__AHC60674

SEQ ID NO: 176686 - RNA, 1410 nt, Artificial Sequence; identical to SEQ ID NO: 172038
  derived and/or modified sequence opt4 from neuraminidase__InfluenzaA__AHC60686

SEQ ID NO: 176687 - RNA, 1410 nt, Artificial Sequence; identical to SEQ ID NO: 176495
  derived and/or modified sequence opt4 from neuraminidase__InfluenzaA__AHC60698

SEQ ID NO: 176688 - RNA, 1410 nt, Artificial Sequence; identical to SEQ ID NO: 176491
  derived and/or modified sequence opt4 from neuraminidase__InfluenzaA__AHC60710

SEQ ID NO: 176689 - RNA, 1410 nt, Artificial Sequence; identical to SEQ ID NO: 176540
  derived and/or modified sequence opt4 from neuraminidase__InfluenzaA__AHC60722

SEQ ID NO: 176690 - RNA, 1410 nt, Artificial Sequence
  derived and/or modified sequence opt4 from neuraminidase__InfluenzaA__AHC60734
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaucaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176691 - RNA, 1410 nt, Artificial Sequence; identical to SEQ ID NO: 176527
  derived and/or modified sequence opt4 from neuraminidase__InfluenzaA__AHC60746

SEQ ID NO: 176692 - RNA, 1410 nt, Artificial Sequence; identical to SEQ ID NO: 176626
  derived and/or modified sequence opt4 from neuraminidase__InfluenzaA__AHC60770

SEQ ID NO: 176693 - RNA, 1410 nt, Artificial Sequence
  derived and/or modified sequence opt4 from neuraminidase__InfluenzaA__AHC60782
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcggcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176694 - RNA, 1410 nt, Artificial Sequence; identical to SEQ ID NO: 176538
  derived and/or modified sequence opt4 from neuraminidase__InfluenzaA__AHC60794

SEQ ID NO: 176695 - RNA, 1410 nt, Artificial Sequence
  derived and/or modified sequence opt4 from neuraminidase__InfluenzaA__AHC60806
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccggcgugcuguggaccagcaacagcaucgugguguucugcggcaccagcggcaccuacggcaccggcagcuggcccgacggcgccgaccugaaccugaugcccaucuga

SEQ ID NO: 176696 - RNA, 1410 nt, Artificial Sequence; identical to SEQ ID NO: 173404
  derived and/or modified sequence opt4 from neuraminidase__InfluenzaA__AHC60818

SEQ ID NO: 176697 - RNA, 1410 nt, Artificial Sequence; identical to SEQ ID NO: 176495
  derived and/or modified sequence opt4 from neuraminidase__InfluenzaA__AHC60830

SEQ ID NO: 176698 - RNA, 1410 nt, Artificial Sequence; identical to SEQ ID NO: 176676
  derived and/or modified sequence opt4 from neuraminidase__InfluenzaA__AHC60842

SEQ ID NO: 176699 - RNA, 1410 nt, Artificial Sequence; identical to SEQ ID NO: 176495
  derived and/or modified sequence opt4 from neuraminidase__InfluenzaA__AHC60854

SEQ ID NO: 176700 - RNA, 1410 nt, Artificial Sequence; identical to SEQ ID NO: 176540
  derived and/or modified sequence opt4 from neuraminidase__InfluenzaA__AHC60866

SEQ ID NO: 176701 - RNA, 1410 nt, Artificial Sequence; identical to SEQ ID NO: 176527
  derived and/or modified sequence opt4 from neuraminidase__InfluenzaA__AHC60878

SEQ ID NO: 176702 - RNA, 1410 nt, Artificial Sequence; identical to SEQ ID NO: 176527
  derived and/or modified sequence opt4 from neuraminidase__InfluenzaA__AHC60890

SEQ ID NO: 176703 - RNA, 1410 nt, Artificial Sequence; identical to SEQ ID NO: 176626
  derived and/or modified sequence opt4 from neuraminidase__InfluenzaA__AHC60902

SEQ ID NO: 176704 - RNA, 1410 nt, Artificial Sequence; identical to SEQ ID NO: 176491
  derived and/or modified sequence opt4 from neuraminidase__InfluenzaA__AHC60914

SEQ ID NO: 176705 - RNA, 1410 nt, Artificial Sequence; identical to SEQ ID NO: 176495
  derived and/or modified sequence opt4 from neuraminidase__InfluenzaA__AHC60926

SEQ ID NO: 176706 - RNA, 1410 nt, Artificial Sequence; identical to SEQ ID NO: 176491
  derived and/or modified sequence opt4 from neuraminidase__InfluenzaA__AHC60938

SEQ ID NO: 176707 - RNA, 1410 nt, Artificial Sequence; identical to SEQ ID NO: 176495
  derived and/or modified sequence opt4 from neuraminidase__InfluenzaA__AHC60950

SEQ ID NO: 176708 - RNA, 1410 nt, Artificial Sequence
  derived and/or modified sequence opt4 from neuraminidase__InfluenzaA__AHC60962
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176709 - RNA, 1410 nt, Artificial Sequence; identical to SEQ ID NO: 176540
  derived and/or modified sequence opt4 from neuraminidase__InfluenzaA__AHC60974

SEQ ID NO: 176710 - RNA, 1410 nt, Artificial Sequence; identical to SEQ ID NO: 176491
  derived and/or modified sequence opt4 from neuraminidase__InfluenzaA__AHC60986

SEQ ID NO: 176711 - RNA, 1410 nt, Artificial Sequence; identical to SEQ ID NO: 176638
  derived and/or modified sequence opt4 from neuraminidase__InfluenzaA__AHC60998

SEQ ID NO: 176712 - RNA, 1410 nt, Artificial Sequence; identical to SEQ ID NO: 176538
  derived and/or modified sequence opt4 from neuraminidase__InfluenzaA__AHC61010

SEQ ID NO: 176713 - RNA, 1410 nt, Artificial Sequence
  derived and/or modified sequence opt4 from neuraminidase__InfluenzaA__AHC61022
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcaucagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176714 - RNA, 1410 nt, Artificial Sequence; identical to SEQ ID NO: 172038
  derived and/or modified sequence opt4 from neuraminidase__InfluenzaA__AHC61034

SEQ ID NO: 176715 - RNA, 1410 nt, Artificial Sequence; identical to SEQ ID NO: 176491
  derived and/or modified sequence opt4 from neuraminidase__InfluenzaA__AHC61046

SEQ ID NO: 176716 - RNA, 1410 nt, Artificial Sequence; identical to SEQ ID NO: 176540
  derived and/or modified sequence opt4 from neuraminidase__InfluenzaA__AHC61058

SEQ ID NO: 176717 - RNA, 1410 nt, Artificial Sequence; identical to SEQ ID NO: 176403
  derived and/or modified sequence opt4 from neuraminidase__InfluenzaA__AHC61070

SEQ ID NO: 176718 - RNA, 1410 nt, Artificial Sequence
  derived and/or modified sequence opt4 from neuraminidase__InfluenzaA__AHC61082
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccggcgugcuguggaccagcaacagcaucgugguguucugcggcaccagcggcaccuacggcaccggcagcuggcccgacggcgccgaccugaaccugaugcccaucuga

SEQ ID NO: 176719 - RNA, 1410 nt, Artificial Sequence; identical to SEQ ID NO: 172038
  derived and/or modified sequence opt4 from neuraminidase__InfluenzaA__AHC61094

SEQ ID NO: 176720 - RNA, 1410 nt, Artificial Sequence; identical to SEQ ID NO: 176527
  derived and/or modified sequence opt4 from neuraminidase__InfluenzaA__AHC61106

SEQ ID NO: 176721 - RNA, 1410 nt, Artificial Sequence; identical to SEQ ID NO: 176527
  derived and/or modified sequence opt4 from neuraminidase__InfluenzaA__AHC61118

SEQ ID NO: 176722 - RNA, 1410 nt, Artificial Sequence; identical to SEQ ID NO: 176491
  derived and/or modified sequence opt4 from neuraminidase__InfluenzaA__AHC61130

SEQ ID NO: 176723 - RNA, 1410 nt, Artificial Sequence; identical to SEQ ID NO: 176638
  derived and/or modified sequence opt4 from neuraminidase__InfluenzaA__AHC61142

SEQ ID NO: 176724 - RNA, 1410 nt, Artificial Sequence; identical to SEQ ID NO: 176527
  derived and/or modified sequence opt4 from neuraminidase__InfluenzaA__AHC61154

SEQ ID NO: 176725 - RNA, 1410 nt, Artificial Sequence
  derived and/or modified sequence opt4 from neuraminidase__InfluenzaA__AHC61166
augaaccccaaccagaagaucaucaccaucggcagcgugagccugaccaucagcaccaucugcuucuucaugcagguggccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176726 - RNA, 1410 nt, Artificial Sequence; identical to SEQ ID NO: 176491
  derived and/or modified sequence opt4 from neuraminidase__InfluenzaA__AHC61178

SEQ ID NO: 176727 - RNA, 1410 nt, Artificial Sequence; identical to SEQ ID NO: 176527
  derived and/or modified sequence opt4 from neuraminidase__InfluenzaA__AHC61190

SEQ ID NO: 176728 - RNA, 1410 nt, Artificial Sequence; identical to SEQ ID NO: 176540
  derived and/or modified sequence opt4 from neuraminidase__InfluenzaA__AHC61202

SEQ ID NO: 176729 - RNA, 1410 nt, Artificial Sequence; identical to SEQ ID NO: 176495
  derived and/or modified sequence opt4 from neuraminidase__InfluenzaA__AHC61214

SEQ ID NO: 176730 - RNA, 1410 nt, Artificial Sequence; identical to SEQ ID NO: 176540
  derived and/or modified sequence opt4 from neuraminidase__InfluenzaA__AHC61226

SEQ ID NO: 176731 - RNA, 1410 nt, Artificial Sequence; identical to SEQ ID NO: 176527
  derived and/or modified sequence opt4 from neuraminidase__InfluenzaA__AHC61238

SEQ ID NO: 176732 - RNA, 1410 nt, Artificial Sequence; identical to SEQ ID NO: 176708
  derived and/or modified sequence opt4 from neuraminidase__InfluenzaA__AHC61250

SEQ ID NO: 176733 - RNA, 1410 nt, Artificial Sequence; identical to SEQ ID NO: 176491
  derived and/or modified sequence opt4 from neuraminidase__InfluenzaA__AHC61262

SEQ ID NO: 176734 - RNA, 1410 nt, Artificial Sequence; identical to SEQ ID NO: 176495
  derived and/or modified sequence opt4 from neuraminidase__InfluenzaA__AHC61274

SEQ ID NO: 176735 - RNA, 1410 nt, Artificial Sequence; identical to SEQ ID NO: 172038
  derived and/or modified sequence opt4 from neuraminidase__InfluenzaA__AHC61286

SEQ ID NO: 176736 - RNA, 1410 nt, Artificial Sequence; identical to SEQ ID NO: 176539
  derived and/or modified sequence opt4 from neuraminidase__InfluenzaA__AHC61298

SEQ ID NO: 176737 - RNA, 1410 nt, Artificial Sequence
  derived and/or modified sequence opt4 from neuraminidase__InfluenzaA__AHC61310
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucaucgacagaggcaacagaagcggcuacagcggcaucuucagcguggagggcaagagcugcaucaacagaugcuucuacguggagcugaucagaggcagaaaggaggagaccgaggugcuguggaccagcagcagcaucgugguguucugcggcaccagcggcaccuacggcaccggcagcuggcccgacggcgccgaccugaaccugaugcccaucuga

SEQ ID NO: 176738 - RNA, 1410 nt, Artificial Sequence; identical to SEQ ID NO: 176568
  derived and/or modified sequence opt4 from neuraminidase__InfluenzaA__AHC61322

SEQ ID NO: 176739 - RNA, 1410 nt, Artificial Sequence; identical to SEQ ID NO: 176527
  derived and/or modified sequence opt4 from neuraminidase__InfluenzaA__AHC61334

SEQ ID NO: 176740 - RNA, 1410 nt, Artificial Sequence; identical to SEQ ID NO: 176495
  derived and/or modified sequence opt4 from neuraminidase__InfluenzaA__AHC61346

SEQ ID NO: 176741 - RNA, 1410 nt, Artificial Sequence
  derived and/or modified sequence opt4 from neuraminidase__InfluenzaA__AHC61358
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacaucagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucaagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176742 - RNA, 1410 nt, Artificial Sequence; identical to SEQ ID NO: 176540
  derived and/or modified sequence opt4 from neuraminidase__InfluenzaA__AHC61370

SEQ ID NO: 176743 - RNA, 1410 nt, Artificial Sequence; identical to SEQ ID NO: 176568
  derived and/or modified sequence opt4 from neuraminidase__InfluenzaA__AHC61382

SEQ ID NO: 176744 - RNA, 1410 nt, Artificial Sequence; identical to SEQ ID NO: 176540
  derived and/or modified sequence opt4 from neuraminidase__InfluenzaA__AHC61394

SEQ ID NO: 176745 - RNA, 1410 nt, Artificial Sequence; identical to SEQ ID NO: 176568
  derived and/or modified sequence opt4 from neuraminidase__InfluenzaA__AHC61406

SEQ ID NO: 176746 - RNA, 1410 nt, Artificial Sequence; identical to SEQ ID NO: 176527
  derived and/or modified sequence opt4 from neuraminidase__InfluenzaA__AHC61418

SEQ ID NO: 176747 - RNA, 1410 nt, Artificial Sequence; identical to SEQ ID NO: 172038
  derived and/or modified sequence opt4 from neuraminidase__InfluenzaA__AHC61430

SEQ ID NO: 176748 - RNA, 1410 nt, Artificial Sequence; identical to SEQ ID NO: 176540
  derived and/or modified sequence opt4 from neuraminidase__InfluenzaA__AHC61442

SEQ ID NO: 176749 - RNA, 1410 nt, Artificial Sequence; identical to SEQ ID NO: 176540
  derived and/or modified sequence opt4 from neuraminidase__InfluenzaA__AHC61454

SEQ ID NO: 176750 - RNA, 1410 nt, Artificial Sequence
  derived and/or modified sequence opt4 from neuraminidase__InfluenzaA__AHC61466
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaccaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176751 - RNA, 1410 nt, Artificial Sequence; identical to SEQ ID NO: 176491
  derived and/or modified sequence opt4 from neuraminidase__InfluenzaA__AHC61478

SEQ ID NO: 176752 - RNA, 1410 nt, Artificial Sequence; identical to SEQ ID NO: 176527
  derived and/or modified sequence opt4 from neuraminidase__InfluenzaA__AHC61490

SEQ ID NO: 176753 - RNA, 1410 nt, Artificial Sequence; identical to SEQ ID NO: 176491
  derived and/or modified sequence opt4 from neuraminidase__InfluenzaA__AHC61502

SEQ ID NO: 176754 - RNA, 1410 nt, Artificial Sequence; identical to SEQ ID NO: 176540
  derived and/or modified sequence opt4 from neuraminidase__InfluenzaA__AHC61514

SEQ ID NO: 176755 - RNA, 1410 nt, Artificial Sequence; identical to SEQ ID NO: 175442
  derived and/or modified sequence opt4 from neuraminidase__InfluenzaA__AHC61526

SEQ ID NO: 176756 - RNA, 1410 nt, Artificial Sequence
  derived and/or modified sequence opt4 from neuraminidase__InfluenzaA__AHC61538
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcagccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176757 - RNA, 1410 nt, Artificial Sequence; identical to SEQ ID NO: 176540
  derived and/or modified sequence opt4 from neuraminidase__InfluenzaA__AHC61550

SEQ ID NO: 176758 - RNA, 1410 nt, Artificial Sequence
  derived and/or modified sequence opt4 from neuraminidase__InfluenzaA__AHC61562
augaaccccaaccagaagaucaucaccaucggcagcgugagccugaccaucagcaccaucugcuucuucaugcagaucgccauccugaucaccaccgugacccugcacuucaagcaguacgaguucuacagcccccccaacaaccaggugaugcugugcgagcccaccaugaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagagcaagagcugcaucaacagaugcuucuacguggagcugaucagaggcagaaaggaggagaccgaggugcuguggaccagcaacagcaucgugguguucugcggcaccagcggcaccuacggcaccggcaccuggcccgacggcgccgaccugaaccugaugcccaucuga

SEQ ID NO: 176759 - RNA, 1410 nt, Artificial Sequence; identical to SEQ ID NO: 176539
  derived and/or modified sequence opt4 from neuraminidase__InfluenzaA__AHC61574

SEQ ID NO: 176760 - RNA, 1410 nt, Artificial Sequence; identical to SEQ ID NO: 176540
  derived and/or modified sequence opt4 from neuraminidase__InfluenzaA__AHC61586

SEQ ID NO: 176761 - RNA, 1410 nt, Artificial Sequence; identical to SEQ ID NO: 175442
  derived and/or modified sequence opt4 from neuraminidase__InfluenzaA__AHC61598

SEQ ID NO: 176762 - RNA, 1410 nt, Artificial Sequence; identical to SEQ ID NO: 176491
  derived and/or modified sequence opt4 from neuraminidase__InfluenzaA__AHC61610

SEQ ID NO: 176763 - RNA, 1410 nt, Artificial Sequence; identical to SEQ ID NO: 176539
  derived and/or modified sequence opt4 from neuraminidase__InfluenzaA__AHC61622

SEQ ID NO: 176764 - RNA, 1410 nt, Artificial Sequence; identical to SEQ ID NO: 172038
  derived and/or modified sequence opt4 from neuraminidase__InfluenzaA__AHC61634

SEQ ID NO: 176765 - RNA, 1410 nt, Artificial Sequence; identical to SEQ ID NO: 172038
  derived and/or modified sequence opt4 from neuraminidase__InfluenzaA__AHC61646

SEQ ID NO: 176766 - RNA, 1410 nt, Artificial Sequence; identical to SEQ ID NO: 172038
  derived and/or modified sequence opt4 from neuraminidase__InfluenzaA__AHC61658

SEQ ID NO: 176767 - RNA, 1410 nt, Artificial Sequence; identical to SEQ ID NO: 175442
  derived and/or modified sequence opt4 from neuraminidase__InfluenzaA__AHC61670

SEQ ID NO: 176768 - RNA, 1410 nt, Artificial Sequence; identical to SEQ ID NO: 176495
  derived and/or modified sequence opt4 from neuraminidase__InfluenzaA__AHC61682

SEQ ID NO: 176769 - RNA, 1410 nt, Artificial Sequence; identical to SEQ ID NO: 175442
  derived and/or modified sequence opt4 from neuraminidase__InfluenzaA__AHC61694

SEQ ID NO: 176770 - RNA, 1410 nt, Artificial Sequence
  derived and/or modified sequence opt4 from neuraminidase__InfluenzaA__AHC61706
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggagcacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176771 - RNA, 1410 nt, Artificial Sequence
  derived and/or modified sequence opt4 from neuraminidase__InfluenzaA__AHC61718
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcugaccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccggcgugcuguggaccagcaacagcaucgugguguucugcggcaccagcggcaccuacggcaccggcagcuggcccgacggcgccgaccugaaccugaugcccaucuga

SEQ ID NO: 176772 - RNA, 1410 nt, Artificial Sequence; identical to SEQ ID NO: 176491
  derived and/or modified sequence opt4 from neuraminidase__InfluenzaA__AHC61730

SEQ ID NO: 176773 - RNA, 1410 nt, Artificial Sequence; identical to SEQ ID NO: 176540
  derived and/or modified sequence opt4 from neuraminidase__InfluenzaA__AHC61742

SEQ ID NO: 176774 - RNA, 1410 nt, Artificial Sequence; identical to SEQ ID NO: 176491
  derived and/or modified sequence opt4 from neuraminidase__InfluenzaA__AHC61754

SEQ ID NO: 176775 - RNA, 1410 nt, Artificial Sequence; identical to SEQ ID NO: 172038
  derived and/or modified sequence opt4 from neuraminidase__InfluenzaA__AHC61766

SEQ ID NO: 176776 - RNA, 1410 nt, Artificial Sequence; identical to SEQ ID NO: 176527
  derived and/or modified sequence opt4 from neuraminidase__InfluenzaA__AHC61778

SEQ ID NO: 176777 - RNA, 1410 nt, Artificial Sequence; identical to SEQ ID NO: 176565
  derived and/or modified sequence opt4 from neuraminidase__InfluenzaA__AHC61790

SEQ ID NO: 176778 - RNA, 1410 nt, Artificial Sequence; identical to SEQ ID NO: 176495
  derived and/or modified sequence opt4 from neuraminidase__InfluenzaA__AHC61802

SEQ ID NO: 176779 - RNA, 1410 nt, Artificial Sequence; identical to SEQ ID NO: 176491
  derived and/or modified sequence opt4 from neuraminidase__InfluenzaA__AHC61814

SEQ ID NO: 176780 - RNA, 1410 nt, Artificial Sequence
  derived and/or modified sequence opt4 from neuraminidase__InfluenzaA__AHC61826
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176781 - RNA, 1410 nt, Artificial Sequence; identical to SEQ ID NO: 176491
  derived and/or modified sequence opt4 from neuraminidase__InfluenzaA__AHC61838

SEQ ID NO: 176782 - RNA, 1410 nt, Artificial Sequence; identical to SEQ ID NO: 176527
  derived and/or modified sequence opt4 from neuraminidase__InfluenzaA__AHC61850

SEQ ID NO: 176783 - RNA, 1410 nt, Artificial Sequence; identical to SEQ ID NO: 176540
  derived and/or modified sequence opt4 from neuraminidase__InfluenzaA__AHC61862

SEQ ID NO: 176784 - RNA, 1410 nt, Artificial Sequence; identical to SEQ ID NO: 176491
  derived and/or modified sequence opt4 from neuraminidase__InfluenzaA__AHC61874

SEQ ID NO: 176785 - RNA, 1410 nt, Artificial Sequence
  derived and/or modified sequence opt4 from neuraminidase__InfluenzaA__AHC61886
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccagguggugcugugcgagcccaccaucaucgagagaaacaucaccgagaucguguaccugaccaacaccaccaucgagaaggagaucugccccaagcccgccgaguacagacacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176786 - RNA, 1410 nt, Artificial Sequence; identical to SEQ ID NO: 176495
  derived and/or modified sequence opt4 from neuraminidase__InfluenzaA__AHC61898

SEQ ID NO: 176787 - RNA, 1410 nt, Artificial Sequence; identical to SEQ ID NO: 176527
  derived and/or modified sequence opt4 from neuraminidase__InfluenzaA__AHC61910

SEQ ID NO: 176788 - RNA, 1410 nt, Artificial Sequence; identical to SEQ ID NO: 172038
  derived and/or modified sequence opt4 from neuraminidase__InfluenzaA__AHC61934

SEQ ID NO: 176789 - RNA, 1410 nt, Artificial Sequence
  derived and/or modified sequence opt4 from neuraminidase__InfluenzaA__AHC61946
augaaccccaaccagaagaucaucaccaucggcagcgugagccugaccaucagcaccaucugcuucuucaugcagaucgccauccugaucaccaccgugacccugcacuucaagcaguacgagagcuacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagaaaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176790 - RNA, 1410 nt, Artificial Sequence; identical to SEQ ID NO: 175442
  derived and/or modified sequence opt4 from neuraminidase__InfluenzaA__AHC61958

SEQ ID NO: 176791 - RNA, 1410 nt, Artificial Sequence; identical to SEQ ID NO: 176491
  derived and/or modified sequence opt4 from neuraminidase__InfluenzaA__AHC61970

SEQ ID NO: 176792 - RNA, 1410 nt, Artificial Sequence
  derived and/or modified sequence opt4 from neuraminidase__InfluenzaA__AHC61982
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacggcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176793 - RNA, 1410 nt, Artificial Sequence; identical to SEQ ID NO: 176495
  derived and/or modified sequence opt4 from neuraminidase__InfluenzaA__AHC61994

SEQ ID NO: 176794 - RNA, 1410 nt, Artificial Sequence; identical to SEQ ID NO: 176527
  derived and/or modified sequence opt4 from neuraminidase__InfluenzaA__AHC62006

SEQ ID NO: 176795 - RNA, 1410 nt, Artificial Sequence; identical to SEQ ID NO: 176491
  derived and/or modified sequence opt4 from neuraminidase__InfluenzaA__AHC62018

SEQ ID NO: 176796 - RNA, 1410 nt, Artificial Sequence; identical to SEQ ID NO: 175442
  derived and/or modified sequence opt4 from neuraminidase__InfluenzaA__AHC62030

SEQ ID NO: 176797 - RNA, 1410 nt, Artificial Sequence; identical to SEQ ID NO: 176495
  derived and/or modified sequence opt4 from neuraminidase__InfluenzaA__AHC62042

SEQ ID NO: 176798 - RNA, 1410 nt, Artificial Sequence; identical to SEQ ID NO: 176568
  derived and/or modified sequence opt4 from neuraminidase__InfluenzaA__AHC62053

SEQ ID NO: 176799 - RNA, 1410 nt, Artificial Sequence
  derived and/or modified sequence opt4 from neuraminidase__InfluenzaA__AHC62065
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176800 - RNA, 1410 nt, Artificial Sequence; identical to SEQ ID NO: 176626
  derived and/or modified sequence opt4 from neuraminidase__InfluenzaA__AHC62077

SEQ ID NO: 176801 - RNA, 1410 nt, Artificial Sequence; identical to SEQ ID NO: 176540
  derived and/or modified sequence opt4 from neuraminidase__InfluenzaA__AHC62089

SEQ ID NO: 176802 - RNA, 1410 nt, Artificial Sequence; identical to SEQ ID NO: 176491
  derived and/or modified sequence opt4 from neuraminidase__InfluenzaA__AHC62101

SEQ ID NO: 176803 - RNA, 1410 nt, Artificial Sequence; identical to SEQ ID NO: 176540
  derived and/or modified sequence opt4 from neuraminidase__InfluenzaA__AHC62113

SEQ ID NO: 176804 - RNA, 1410 nt, Artificial Sequence
  derived and/or modified sequence opt4 from neuraminidase__InfluenzaA__AHC62125
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacaagagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176805 - RNA, 1410 nt, Artificial Sequence
  derived and/or modified sequence opt4 from neuraminidase__InfluenzaA__AHC62137
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176806 - RNA, 1410 nt, Artificial Sequence
  derived and/or modified sequence opt4 from neuraminidase__InfluenzaA__AHC62149
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucagagaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176807 - RNA, 1410 nt, Artificial Sequence; identical to SEQ ID NO: 176527
  derived and/or modified sequence opt4 from neuraminidase__InfluenzaA__AHC62161

SEQ ID NO: 176808 - RNA, 1410 nt, Artificial Sequence
  derived and/or modified sequence opt4 from neuraminidase__InfluenzaA__AHC62173
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176809 - RNA, 1410 nt, Artificial Sequence; identical to SEQ ID NO: 176540
  derived and/or modified sequence opt4 from neuraminidase__InfluenzaA__AHC62185

SEQ ID NO: 176810 - RNA, 1410 nt, Artificial Sequence; identical to SEQ ID NO: 175442
  derived and/or modified sequence opt4 from neuraminidase__InfluenzaA__AHC62197

SEQ ID NO: 176811 - RNA, 1410 nt, Artificial Sequence
  derived and/or modified sequence opt4 from neuraminidase__InfluenzaA__AHC62209
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176812 - RNA, 1410 nt, Artificial Sequence; identical to SEQ ID NO: 176495
  derived and/or modified sequence opt4 from neuraminidase__InfluenzaA__AHC62221

SEQ ID NO: 176813 - RNA, 1410 nt, Artificial Sequence; identical to SEQ ID NO: 172038
  derived and/or modified sequence opt4 from neuraminidase__InfluenzaA__AHC62233

SEQ ID NO: 176814 - RNA, 1410 nt, Artificial Sequence; identical to SEQ ID NO: 176491
  derived and/or modified sequence opt4 from neuraminidase__InfluenzaA__AHC62245

SEQ ID NO: 176815 - RNA, 1410 nt, Artificial Sequence
  derived and/or modified sequence opt4 from neuraminidase__InfluenzaA__AHC62257
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugggcagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176816 - RNA, 1410 nt, Artificial Sequence; identical to SEQ ID NO: 176568
  derived and/or modified sequence opt4 from neuraminidase__InfluenzaA__AHC62269

SEQ ID NO: 176817 - RNA, 1410 nt, Artificial Sequence; identical to SEQ ID NO: 176540
  derived and/or modified sequence opt4 from neuraminidase__InfluenzaA__AHC62281

SEQ ID NO: 176818 - RNA, 1410 nt, Artificial Sequence; identical to SEQ ID NO: 176495
  derived and/or modified sequence opt4 from neuraminidase__InfluenzaA__AHC62293

SEQ ID NO: 176819 - RNA, 1410 nt, Artificial Sequence; identical to SEQ ID NO: 172038
  derived and/or modified sequence opt4 from neuraminidase__InfluenzaA__AHC62305

SEQ ID NO: 176820 - RNA, 1410 nt, Artificial Sequence; identical to SEQ ID NO: 176491
  derived and/or modified sequence opt4 from neuraminidase__InfluenzaA__AHC62317

SEQ ID NO: 176821 - RNA, 1410 nt, Artificial Sequence
  derived and/or modified sequence opt4 from neuraminidase__InfluenzaA__AHC62329
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgccgacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176822 - RNA, 1410 nt, Artificial Sequence; identical to SEQ ID NO: 176491
  derived and/or modified sequence opt4 from neuraminidase__InfluenzaA__AHC62341

SEQ ID NO: 176823 - RNA, 1410 nt, Artificial Sequence
  derived and/or modified sequence opt4 from neuraminidase__InfluenzaA__AHC62353
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176824 - RNA, 1410 nt, Artificial Sequence; identical to SEQ ID NO: 176491
  derived and/or modified sequence opt4 from neuraminidase__InfluenzaA__AHC62365

SEQ ID NO: 176825 - RNA, 1410 nt, Artificial Sequence; identical to SEQ ID NO: 176708
  derived and/or modified sequence opt4 from neuraminidase__InfluenzaA__AHC62377

SEQ ID NO: 176826 - RNA, 1410 nt, Artificial Sequence; identical to SEQ ID NO: 176540
  derived and/or modified sequence opt4 from neuraminidase__InfluenzaA__AHC62389

SEQ ID NO: 176827 - RNA, 1410 nt, Artificial Sequence; identical to SEQ ID NO: 176540
  derived and/or modified sequence opt4 from neuraminidase__InfluenzaA__AHC62401

SEQ ID NO: 176828 - RNA, 1410 nt, Artificial Sequence; identical to SEQ ID NO: 176568
  derived and/or modified sequence opt4 from neuraminidase__InfluenzaA__AHC62413

SEQ ID NO: 176829 - RNA, 1410 nt, Artificial Sequence; identical to SEQ ID NO: 176626
  derived and/or modified sequence opt4 from neuraminidase__InfluenzaA__AHC62425

SEQ ID NO: 176830 - RNA, 1410 nt, Artificial Sequence; identical to SEQ ID NO: 172038
  derived and/or modified sequence opt4 from neuraminidase__InfluenzaA__AHC62437

SEQ ID NO: 176831 - RNA, 1410 nt, Artificial Sequence; identical to SEQ ID NO: 176540
  derived and/or modified sequence opt4 from neuraminidase__InfluenzaA__AHC62449

SEQ ID NO: 176832 - RNA, 1410 nt, Artificial Sequence; identical to SEQ ID NO: 176495
  derived and/or modified sequence opt4 from neuraminidase__InfluenzaA__AHC62461

SEQ ID NO: 176833 - RNA, 1410 nt, Artificial Sequence; identical to SEQ ID NO: 176491
  derived and/or modified sequence opt4 from neuraminidase__InfluenzaA__AHC62473

SEQ ID NO: 176834 - RNA, 1410 nt, Artificial Sequence; identical to SEQ ID NO: 174666
  derived and/or modified sequence opt4 from neuraminidase__InfluenzaA__AHC62485

SEQ ID NO: 176835 - RNA, 1410 nt, Artificial Sequence; identical to SEQ ID NO: 176540
  derived and/or modified sequence opt4 from neuraminidase__InfluenzaA__AHC62509

SEQ ID NO: 176836 - RNA, 1410 nt, Artificial Sequence
  derived and/or modified sequence opt4 from neuraminidase__InfluenzaA__AHC62521
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucaucguguucugcggcaccagcggcaccuacggcaccggcagcuggcccgacggcgccgaccugaaccugaugcccaucuga

SEQ ID NO: 176837 - RNA, 1410 nt, Artificial Sequence
  derived and/or modified sequence opt4 from neuraminidase__InfluenzaA__AHC62533
augaaccccaaccagaagaucaucaccaucggcagcgugagccugaccaucagcaccaucugcuucuucaugcagguggccauccugaucaccaccgugacccugcacuucaagcaguacgaguucaacagcccccccaacaaccaggugaugcugugcgagcccaccaucaucgagagaaacaucaccgagauccuguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggcaacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176838 - RNA, 1410 nt, Artificial Sequence; identical to SEQ ID NO: 176695
  derived and/or modified sequence opt4 from neuraminidase__InfluenzaA__AHC62545

SEQ ID NO: 176839 - RNA, 1410 nt, Artificial Sequence; identical to SEQ ID NO: 176540
  derived and/or modified sequence opt4 from neuraminidase__InfluenzaA__AHC62557

SEQ ID NO: 176840 - RNA, 1410 nt, Artificial Sequence; identical to SEQ ID NO: 176491
  derived and/or modified sequence opt4 from neuraminidase__InfluenzaA__AHC62569

SEQ ID NO: 176841 - RNA, 1410 nt, Artificial Sequence; identical to SEQ ID NO: 176540
  derived and/or modified sequence opt4 from neuraminidase__InfluenzaA__AHC62581

SEQ ID NO: 176842 - RNA, 1410 nt, Artificial Sequence
  derived and/or modified sequence opt4 from neuraminidase__InfluenzaA__AHC62593
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcaacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176843 - RNA, 1410 nt, Artificial Sequence; identical to SEQ ID NO: 176527
  derived and/or modified sequence opt4 from neuraminidase__InfluenzaA__AHC62605

SEQ ID NO: 176844 - RNA, 1410 nt, Artificial Sequence
  derived and/or modified sequence opt4 from neuraminidase__InfluenzaA__AHC62617
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugagaugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176845 - RNA, 1410 nt, Artificial Sequence; identical to SEQ ID NO: 176495
  derived and/or modified sequence opt4 from neuraminidase__InfluenzaA__AHC62629

SEQ ID NO: 176846 - RNA, 1410 nt, Artificial Sequence
  derived and/or modified sequence opt4 from neuraminidase__InfluenzaA__AHC62641
augaaccccaaccagaagaucaucaccaucggcagcgugagccugaccaucagcaccgugugcuucuucaugcagguggccauccugaucaccaccgugacccugcacuucaagcaguacgaguucaacagcccccccaacaaccaggugaugcugugcgagcccaccaucaucgagagaaacaucaccgagauccuguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176847 - RNA, 1410 nt, Artificial Sequence; identical to SEQ ID NO: 176495
  derived and/or modified sequence opt4 from neuraminidase__InfluenzaA__AHC62653

SEQ ID NO: 176848 - RNA, 1410 nt, Artificial Sequence; identical to SEQ ID NO: 176495
  derived and/or modified sequence opt4 from neuraminidase__InfluenzaA__AHC62665

SEQ ID NO: 176849 - RNA, 1410 nt, Artificial Sequence
  derived and/or modified sequence opt4 from neuraminidase__InfluenzaA__AHC62677
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccaacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacaucagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176850 - RNA, 1398 nt, Artificial Sequence
  derived and/or modified sequence opt4 from neuraminidase__InfluenzaA__AHF20560
augaaccccaaccagaagauccugugcaccagcgccaccgccaucaucaucggcgccaucaccgugcugaucggcaucgccaaccugggccugaacaucggccugcaccugaagcccggcugcaacugcagccacagccagcccgagaccaccaacaccagccagaccaucaucaacaacuacuacaacgagaccaacaccaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccuggagcaguggaacuggcccgacggcgccaagaucgaguacuuccuguga

SEQ ID NO: 176851 - RNA, 1398 nt, Artificial Sequence; identical to SEQ ID NO: 175974
  derived and/or modified sequence opt4 from neuraminidase__InfluenzaA__AHF20570

SEQ ID NO: 176852 - RNA, 1413 nt, Artificial Sequence; identical to SEQ ID NO: 169152
  derived and/or modified sequence opt4 from neuraminidase__InfluenzaA__AHG96111

SEQ ID NO: 176853 - RNA, 1413 nt, Artificial Sequence; identical to SEQ ID NO: 169152
  derived and/or modified sequence opt4 from neuraminidase__InfluenzaA__AHG96123

SEQ ID NO: 176854 - RNA, 1413 nt, Artificial Sequence; identical to SEQ ID NO: 169152
  derived and/or modified sequence opt4 from neuraminidase__InfluenzaA__AHG96135

SEQ ID NO: 176855 - RNA, 1413 nt, Artificial Sequence; identical to SEQ ID NO: 169152
  derived and/or modified sequence opt4 from neuraminidase__InfluenzaA__AHG96147

SEQ ID NO: 176856 - RNA, 1413 nt, Artificial Sequence; identical to SEQ ID NO: 169152
  derived and/or modified sequence opt4 from neuraminidase__InfluenzaA__AHG96159

SEQ ID NO: 176857 - RNA, 1413 nt, Artificial Sequence; identical to SEQ ID NO: 169152
  derived and/or modified sequence opt4 from neuraminidase__InfluenzaA__AHG96171

SEQ ID NO: 176858 - RNA, 1413 nt, Artificial Sequence; identical to SEQ ID NO: 169152
  derived and/or modified sequence opt4 from neuraminidase__InfluenzaA__AHG96183

SEQ ID NO: 176859 - RNA, 1413 nt, Artificial Sequence; identical to SEQ ID NO: 169152
  derived and/or modified sequence opt4 from neuraminidase__InfluenzaA__AHG96195

SEQ ID NO: 176860 - RNA, 1413 nt, Artificial Sequence; identical to SEQ ID NO: 169152
  derived and/or modified sequence opt4 from neuraminidase__InfluenzaA__AHG96207

SEQ ID NO: 176861 - RNA, 1413 nt, Artificial Sequence; identical to SEQ ID NO: 169152
  derived and/or modified sequence opt4 from neuraminidase__InfluenzaA__AHG96219

SEQ ID NO: 176862 - RNA, 1413 nt, Artificial Sequence; identical to SEQ ID NO: 169152
  derived and/or modified sequence opt4 from neuraminidase__InfluenzaA__AHG96231

SEQ ID NO: 176863 - RNA, 1413 nt, Artificial Sequence; identical to SEQ ID NO: 169152
  derived and/or modified sequence opt4 from neuraminidase__InfluenzaA__AHG96243

SEQ ID NO: 176864 - RNA, 1413 nt, Artificial Sequence; identical to SEQ ID NO: 169152
  derived and/or modified sequence opt4 from neuraminidase__InfluenzaA__AHG96255

SEQ ID NO: 176865 - RNA, 1413 nt, Artificial Sequence; identical to SEQ ID NO: 169152
  derived and/or modified sequence opt4 from neuraminidase__InfluenzaA__AHG96267

SEQ ID NO: 176866 - RNA, 1413 nt, Artificial Sequence; identical to SEQ ID NO: 169152
  derived and/or modified sequence opt4 from neuraminidase__InfluenzaA__AHG96279

SEQ ID NO: 176867 - RNA, 1413 nt, Artificial Sequence; identical to SEQ ID NO: 169152
  derived and/or modified sequence opt4 from neuraminidase__InfluenzaA__AHG96291

SEQ ID NO: 176868 - RNA, 1413 nt, Artificial Sequence; identical to SEQ ID NO: 169152
  derived and/or modified sequence opt4 from neuraminidase__InfluenzaA__AHG96303

SEQ ID NO: 176869 - RNA, 1410 nt, Artificial Sequence; identical to SEQ ID NO: 168976
  derived and/or modified sequence opt4 from neuraminidase__InfluenzaA__AHG96362

SEQ ID NO: 176870 - RNA, 1410 nt, Artificial Sequence; identical to SEQ ID NO: 168976
  derived and/or modified sequence opt4 from neuraminidase__InfluenzaA__AHG96374

SEQ ID NO: 176871 - RNA, 1410 nt, Artificial Sequence; identical to SEQ ID NO: 168976
  derived and/or modified sequence opt4 from neuraminidase__InfluenzaA__AHG96386

SEQ ID NO: 176872 - RNA, 1413 nt, Artificial Sequence; identical to SEQ ID NO: 169152
  derived and/or modified sequence opt4 from neuraminidase__InfluenzaA__AHG96398

SEQ ID NO: 176873 - RNA, 1410 nt, Artificial Sequence; identical to SEQ ID NO: 168976
  derived and/or modified sequence opt4 from neuraminidase__InfluenzaA__AHG96410

SEQ ID NO: 176874 - RNA, 1410 nt, Artificial Sequence; identical to SEQ ID NO: 168976
  derived and/or modified sequence opt4 from neuraminidase__InfluenzaA__AHG96422

SEQ ID NO: 176875 - RNA, 1410 nt, Artificial Sequence; identical to SEQ ID NO: 168976
  derived and/or modified sequence opt4 from neuraminidase__InfluenzaA__AHG96434

SEQ ID NO: 176876 - RNA, 1410 nt, Artificial Sequence; identical to SEQ ID NO: 168976
  derived and/or modified sequence opt4 from neuraminidase__InfluenzaA__AHG96446

SEQ ID NO: 176877 - RNA, 1410 nt, Artificial Sequence; identical to SEQ ID NO: 168976
  derived and/or modified sequence opt4 from neuraminidase__InfluenzaA__AHG96458

SEQ ID NO: 176878 - RNA, 1410 nt, Artificial Sequence; identical to SEQ ID NO: 168976
  derived and/or modified sequence opt4 from neuraminidase__InfluenzaA__AHG96470

SEQ ID NO: 176879 - RNA, 1410 nt, Artificial Sequence; identical to SEQ ID NO: 168976
  derived and/or modified sequence opt4 from neuraminidase__InfluenzaA__AHG96482

SEQ ID NO: 176880 - RNA, 1410 nt, Artificial Sequence; identical to SEQ ID NO: 168976
  derived and/or modified sequence opt4 from neuraminidase__InfluenzaA__AHG96494

SEQ ID NO: 176881 - RNA, 1410 nt, Artificial Sequence; identical to SEQ ID NO: 168976
  derived and/or modified sequence opt4 from neuraminidase__InfluenzaA__AHG96506

SEQ ID NO: 176882 - RNA, 1413 nt, Artificial Sequence; identical to SEQ ID NO: 169152
  derived and/or modified sequence opt4 from neuraminidase__InfluenzaA__AHG96518

SEQ ID NO: 176883 - RNA, 1413 nt, Artificial Sequence; identical to SEQ ID NO: 169152
  derived and/or modified sequence opt4 from neuraminidase__InfluenzaA__AHG96530

SEQ ID NO: 176884 - RNA, 1413 nt, Artificial Sequence; identical to SEQ ID NO: 169152
  derived and/or modified sequence opt4 from neuraminidase__InfluenzaA__AHG96542

SEQ ID NO: 176885 - RNA, 1413 nt, Artificial Sequence; identical to SEQ ID NO: 169152
  derived and/or modified sequence opt4 from neuraminidase__InfluenzaA__AHG96554

SEQ ID NO: 176886 - RNA, 1413 nt, Artificial Sequence; identical to SEQ ID NO: 169152
  derived and/or modified sequence opt4 from neuraminidase__InfluenzaA__AHG96566

SEQ ID NO: 176887 - RNA, 1413 nt, Artificial Sequence; identical to SEQ ID NO: 169152
  derived and/or modified sequence opt4 from neuraminidase__InfluenzaA__AHG96578

SEQ ID NO: 176888 - RNA, 1413 nt, Artificial Sequence; identical to SEQ ID NO: 169152
  derived and/or modified sequence opt4 from neuraminidase__InfluenzaA__AHG96590

SEQ ID NO: 176889 - RNA, 1413 nt, Artificial Sequence; identical to SEQ ID NO: 169152
  derived and/or modified sequence opt4 from neuraminidase__InfluenzaA__AHG96602

SEQ ID NO: 176890 - RNA, 1413 nt, Artificial Sequence; identical to SEQ ID NO: 169152
  derived and/or modified sequence opt4 from neuraminidase__InfluenzaA__AHG96614

SEQ ID NO: 176891 - RNA, 1413 nt, Artificial Sequence; identical to SEQ ID NO: 169152
  derived and/or modified sequence opt4 from neuraminidase__InfluenzaA__AHG96626

SEQ ID NO: 176892 - RNA, 1413 nt, Artificial Sequence; identical to SEQ ID NO: 169152
  derived and/or modified sequence opt4 from neuraminidase__InfluenzaA__AHG96638

SEQ ID NO: 176893 - RNA, 1413 nt, Artificial Sequence; identical to SEQ ID NO: 169152
  derived and/or modified sequence opt4 from neuraminidase__InfluenzaA__AHG96650

SEQ ID NO: 176894 - RNA, 1413 nt, Artificial Sequence; identical to SEQ ID NO: 169152
  derived and/or modified sequence opt4 from neuraminidase__InfluenzaA__AHG96662

SEQ ID NO: 176895 - RNA, 1413 nt, Artificial Sequence; identical to SEQ ID NO: 169152
  derived and/or modified sequence opt4 from neuraminidase__InfluenzaA__AHG96674

SEQ ID NO: 176896 - RNA, 1413 nt, Artificial Sequence; identical to SEQ ID NO: 169152
  derived and/or modified sequence opt4 from neuraminidase__InfluenzaA__AHG96686

SEQ ID NO: 176897 - RNA, 1410 nt, Artificial Sequence; identical to SEQ ID NO: 168976
  derived and/or modified sequence opt4 from neuraminidase__InfluenzaA__AHG96698

SEQ ID NO: 176898 - RNA, 1410 nt, Artificial Sequence; identical to SEQ ID NO: 168976
  derived and/or modified sequence opt4 from neuraminidase__InfluenzaA__AHG96710

SEQ ID NO: 176899 - RNA, 1410 nt, Artificial Sequence; identical to SEQ ID NO: 168976
  derived and/or modified sequence opt4 from neuraminidase__InfluenzaA__AHG96722

SEQ ID NO: 176900 - RNA, 1410 nt, Artificial Sequence; identical to SEQ ID NO: 168976
  derived and/or modified sequence opt4 from neuraminidase__InfluenzaA__AHG96734

SEQ ID NO: 176901 - RNA, 1410 nt, Artificial Sequence; identical to SEQ ID NO: 168976
  derived and/or modified sequence opt4 from neuraminidase__InfluenzaA__AHG96746

SEQ ID NO: 176902 - RNA, 1410 nt, Artificial Sequence; identical to SEQ ID NO: 168976
  derived and/or modified sequence opt4 from neuraminidase__InfluenzaA__AHG96758

SEQ ID NO: 176903 - RNA, 1410 nt, Artificial Sequence; identical to SEQ ID NO: 168976
  derived and/or modified sequence opt4 from neuraminidase__InfluenzaA__AHG96770

SEQ ID NO: 176904 - RNA, 1410 nt, Artificial Sequence; identical to SEQ ID NO: 168976
  derived and/or modified sequence opt4 from neuraminidase__InfluenzaA__AHG96782

SEQ ID NO: 176905 - RNA, 1410 nt, Artificial Sequence; identical to SEQ ID NO: 168976
  derived and/or modified sequence opt4 from neuraminidase__InfluenzaA__AHG96794

SEQ ID NO: 176906 - RNA, 1410 nt, Artificial Sequence; identical to SEQ ID NO: 168976
  derived and/or modified sequence opt4 from neuraminidase__InfluenzaA__AHG96806

SEQ ID NO: 176907 - RNA, 1410 nt, Artificial Sequence; identical to SEQ ID NO: 168976
  derived and/or modified sequence opt4 from neuraminidase__InfluenzaA__AHG96818

SEQ ID NO: 176908 - RNA, 1410 nt, Artificial Sequence; identical to SEQ ID NO: 168976
  derived and/or modified sequence opt4 from neuraminidase__InfluenzaA__AHG96830

SEQ ID NO: 176909 - RNA, 1410 nt, Artificial Sequence; identical to SEQ ID NO: 168976
  derived and/or modified sequence opt4 from neuraminidase__InfluenzaA__AHG96842

SEQ ID NO: 176910 - RNA, 1410 nt, Artificial Sequence; identical to SEQ ID NO: 168976
  derived and/or modified sequence opt4 from neuraminidase__InfluenzaA__AHG96854

SEQ ID NO: 176911 - RNA, 1410 nt, Artificial Sequence; identical to SEQ ID NO: 168976
  derived and/or modified sequence opt4 from neuraminidase__InfluenzaA__AHG96866

SEQ ID NO: 176912 - RNA, 1410 nt, Artificial Sequence; identical to SEQ ID NO: 168976
  derived and/or modified sequence opt4 from neuraminidase__InfluenzaA__AHG96878

SEQ ID NO: 176913 - RNA, 1410 nt, Artificial Sequence; identical to SEQ ID NO: 168976
  derived and/or modified sequence opt4 from neuraminidase__InfluenzaA__AHG96890

SEQ ID NO: 176914 - RNA, 1410 nt, Artificial Sequence; identical to SEQ ID NO: 168976
  derived and/or modified sequence opt4 from neuraminidase__InfluenzaA__AHG96902

SEQ ID NO: 176915 - RNA, 1410 nt, Artificial Sequence; identical to SEQ ID NO: 168976
  derived and/or modified sequence opt4 from neuraminidase__InfluenzaA__AHG96914

SEQ ID NO: 176916 - RNA, 1410 nt, Artificial Sequence; identical to SEQ ID NO: 168976
  derived and/or modified sequence opt4 from neuraminidase__InfluenzaA__AHG96926

SEQ ID NO: 176917 - RNA, 1410 nt, Artificial Sequence; identical to SEQ ID NO: 168976
  derived and/or modified sequence opt4 from neuraminidase__InfluenzaA__AHG96938

SEQ ID NO: 176918 - RNA, 1410 nt, Artificial Sequence; identical to SEQ ID NO: 168976
  derived and/or modified sequence opt4 from neuraminidase__InfluenzaA__AHG96950

SEQ ID NO: 176919 - RNA, 1410 nt, Artificial Sequence; identical to SEQ ID NO: 168976
  derived and/or modified sequence opt4 from neuraminidase__InfluenzaA__AHG96962

SEQ ID NO: 176920 - RNA, 1410 nt, Artificial Sequence; identical to SEQ ID NO: 168976
  derived and/or modified sequence opt4 from neuraminidase__InfluenzaA__AHG96974

SEQ ID NO: 176921 - RNA, 1410 nt, Artificial Sequence; identical to SEQ ID NO: 168976
  derived and/or modified sequence opt4 from neuraminidase__InfluenzaA__AHG96986

SEQ ID NO: 176922 - RNA, 1410 nt, Artificial Sequence; identical to SEQ ID NO: 168976
  derived and/or modified sequence opt4 from neuraminidase__InfluenzaA__AHG96998

SEQ ID NO: 176923 - RNA, 1410 nt, Artificial Sequence; identical to SEQ ID NO: 168976
  derived and/or modified sequence opt4 from neuraminidase__InfluenzaA__AHG97010

SEQ ID NO: 176924 - RNA, 1410 nt, Artificial Sequence; identical to SEQ ID NO: 168976
  derived and/or modified sequence opt4 from neuraminidase__InfluenzaA__AHG97022

SEQ ID NO: 176925 - RNA, 1410 nt, Artificial Sequence; identical to SEQ ID NO: 168976
  derived and/or modified sequence opt4 from neuraminidase__InfluenzaA__AHG97034

SEQ ID NO: 176926 - RNA, 1410 nt, Artificial Sequence; identical to SEQ ID NO: 168976
  derived and/or modified sequence opt4 from neuraminidase__InfluenzaA__AHG97046

SEQ ID NO: 176927 - RNA, 1410 nt, Artificial Sequence
  derived and/or modified sequence opt4 from neuraminidase__InfluenzaA__AHH00872
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccgugaucaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaagcccaacagcaagcugcagaucaacagacaggugaucaucgacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgaccugaaccugaugcccaucuga

SEQ ID NO: 176928 - RNA, 1416 nt, Artificial Sequence
  derived and/or modified sequence opt4 from neuraminidase__InfluenzaA__AHI43497
augaaccccaaccagaagcuguucgcccugagcggcguggccaucgcccugagcauccugaaccugcugaucggcaucagcaacgugggccugaacaucagccugcaccugaagggcaagggccccaagcaggaggagaaccugaccugcaccaccaucaaccagaacaacaccaccgugguggagaacaccuacgugaacaacaccaccaucaucaccaaggagaccgacuggaacacccccagcuaccugcugcugaacaagagccugugcaacguggagggcuggguggugaucgccaaggacaacgccaucagauucggcgagagcgagcagaucaucgugaccagagagcccuacgugagcugcgaccccaccggcugcaagauguacgcccugcaccagggcaccaccaucagaaacaagcacagcaacggcaccauccacgacagaaccgccuucagaggccugaucagcaccccccugggcaccccccccaccgugagcaacagcggcuucaugugcgugggcuggagcagcaccaccugccacgacggcaucggcagaaugaccaucugcauccagggcaacaacgacaacgccaccgccaccguguacuacaacggcagacugaccaccaccaucaagaccugggccagaaacauccugagaacccaggagagcgagugcgugugccacaacggcaccugcgccguggugaugaccgacggcagcgccagcagccaggccuacaccaaggugauguacuuccacaagggccuggugaucaaggaggaggcccugagaggcagcgccagacacaucgaggagugcagcugcuacggccacagccagagagugaccugcgugugcagagacaacuggcagggcgccaacagacccaucaucgagaucgacaugaacacccuggagcacaccagcagauacgugugcaccggcauccugaccgacaccagcagacccggcgacaagagcagcggcgacugcagcaaccccaucaccggcagccccggcgcccagggcgugaagggcuucggcuuccugaacggcgacaacaccuggcugggcagaaccaucagccccagaagcagaagcggcuucgagaugcugaagauccccaacgccggcaccgaccccaacagcagaaucgccgagagacaggagaucguggacaacaacaacuggagcggcuacagcggcagcuucaucgacuacuggaacaacaacagcgagugcuacaaccccugcuucuacguggagcugaucagaggcagacccgaggaggccaaguacgugugguggaccagcaacagccugaucgcccugugcggcagccccuuccccgugggcagcggcagcuuccccgacggcgcccagauccaguacuucagcuga

SEQ ID NO: 176929 - RNA, 1410 nt, Artificial Sequence
  derived and/or modified sequence opt4 from neuraminidase__InfluenzaA__AHJ57439
augaaccccaaccagaagaucaucaccaucggcagcgugagccugaucaucagcaccaucugcuucuucaugcagguggccauccugcugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176930 - RNA, 1410 nt, Artificial Sequence
  derived and/or modified sequence opt4 from neuraminidase__InfluenzaA__AHJ57440
augaaccccaaccagaagaucaucaccaucggcagcgugagccugaucaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176931 - RNA, 1410 nt, Artificial Sequence
  derived and/or modified sequence opt4 from neuraminidase__InfluenzaA__AHJ57441
augaaccccaaccagaagaucaucaccaucggcagcgugagccugaucaucagcaccaucugcuucuucaugcagaucgccauccugaucaccaccgugacccugcacuucaagcaguacgaguucaacagcccccccaacaaccaggugaugcugugcgagcccaccaucaucgagagaaacaagaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 176932 - RNA, 1413 nt, Artificial Sequence
  derived and/or modified sequence opt4 from neuraminidase__InfluenzaA__AHJ57654
augaaccccaaccagaagaucaccugcaucagcgccaccggcaugacccugagcguggugagccugcugaucggcaucgccaaccugggccugaacaucggccugcacuacaaggugagcgacagcaccaacaucaacauccccaacaugaacgagaccagccccaccaccaccaucaucaacaaccacccccagaacaacuucaccaacaucaccaacaucaucaugaacaagaacgaggagggcaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaaggugcagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaagauccccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176933 - RNA, 1410 nt, Artificial Sequence
  derived and/or modified sequence opt4 from neuraminidase__InfluenzaA__AHJ57666
augaaccccaaccagaagaucaucaccaucggcagcgugagccugaccaucgccaccgugagcuuccugaugcagaucgccauccugaccaccaccgugacccugcacuucaagcacaacgagugcaacaugccccccaagaaccaggugaugagcugcgagcccaucaucaucgagagaaacaucaccgagaucguguaccugaacaacaccaccguggagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacaucugcaucaccggcgacgacagaaacgccaccgccagcuucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucgacaucaacauggccgacuacagcaucgacagcaacuacgugugcagcggccuggugggcgacacccccagaaacgacgacaacagcagcagcagcaacugcagagaccccaacaacgagagaggcaaccccggcgugaagggcugggccuucgacgacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucaagggcagaccccaggagcccagagugugguggaccagcaacagcaucgugguguucugcggcaccagcggcaccuacggcaccggcagcuggcccgacggcgccaacaucaacuucaugcccaucuga

SEQ ID NO: 176934 - RNA, 1413 nt, Artificial Sequence
  derived and/or modified sequence opt4 from neuraminidase__InfluenzaA__AHJ57677
augaaccccaaccagaagaucaccugcaucagcgccaccggcaugacccugagcguggugagcaugcugaucggcaucgccaaccugggccugaacaucggccugcacuacaaggugagcgacagcaccaacaucaacauccccaacaugaacgagaccagccccaccaccaccgugaucaacaaccacccccagaacaacuucaccaacaucaccaacaucaucgugaacaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggccagcacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagguggaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaugaucgugaacaaccagaacuggagcggcuacagcggcgccuucaucgacuacugggccaagaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176935 - RNA, 1413 nt, Artificial Sequence
  derived and/or modified sequence opt4 from neuraminidase__InfluenzaA__AHJ57689
augaaccccaaccagaagaucaccugcaucagcgccaccggcaugacccugagcguggugagcaugcugaucggcaucgccaaccugggccugaacaucggccugcacuacaaggugagcgacagcaccaacaucaacauccccaagaugaacgagaccagccccaccaccaccaucaucaacaaccacccccagaacaacuucaccaacaucaccaacaucaucgugaacaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggccagcacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176936 - RNA, 1413 nt, Artificial Sequence
  derived and/or modified sequence opt4 from neuraminidase__InfluenzaA__AHJ57700
augaaccccaaccagaagaucaccugcaucagcgccaccggcaugacccugagcguggugagccugcugaucggcaucgccaaccugggccugaacaucggccugcacuacaaggugagcgacagcaccaacaucaacauccccaacaugaacgagaccagccccaccaccaccaucaucaacaaccacccccagaacaacuucaccaacaucaccaacaucaucaugaacaagaacgaggagggcaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaaggugcagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176937 - RNA, 1410 nt, Artificial Sequence
  derived and/or modified sequence opt4 from neuraminidase__InfluenzaA__AHJ57710
augaaccccaaccagaagaucaucaccaucggcagcgugagccugaccaucgccaccgugagcuuccugaugcagaucgccauccugaccaccaccgugacccugcacuucaagcacaacgagugcaacaugccccccaagaaccaggugaugagcugcgagcccaucaucaucgagagaaacaucaccgagaucguguaccugaacaacaccaccguggagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacaucugcaucaccggcgacgacagaaacgccaccgccagcuucaucuacgacggcaugcugguggacagcaucagcagcuggagcaagaacauccugagaacccaggagagcgagugcgugugcaucaacggcaccugcgccguggugaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucaacaucaacauggccgacuacagcaucgacagcaacuacgugugcagcggccuggugggcgacacccccagaaacgacgacaacagcagcagcagcaacugcagagaccccaacaacgagagaggcaaccccggcgugaagggcugggccuucgacgacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagcccagagugugguggaccagcaacagcaucgugguguucugcggcaccagcggcaccuacggcaccggcagcuggcccgacggcgccaacaucaacuucaugcccaucuga

SEQ ID NO: 176938 - RNA, 1410 nt, Artificial Sequence
  derived and/or modified sequence opt4 from neuraminidase__InfluenzaA__AHJ57734
augaaccccaaccagaagaucaucaccaucggcagcgugagccugaccaucgccaccgugagcuuccugaugcagaucgccauccugaccaccaccgugacccugcacuucaagcacaacgagugcaacaugccccccaagaaccaggugaugagcugcgagcccaucaucaucgagagaaacaucaccgagaucguguaccugaacaacaccaccguggagaaggagaucugccccaagguggccgaguacagaaacuggagcaagccccagugcaagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacaucugcaucaccggcgacgacagaaacgccaccgccagcuucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucaacaucaacauggccgacuacagcaucgacagcaacuacgugugcagcggccuggugggcgacacccccagaaacgacgacaacagcagcagcagcaacugcagagaccccaacaacgagagaggcaaccccggcgugaagggcugggccuucgacgacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagcccagagugugguggaccagcaacagcaucgugguguucugcggcaccagcggcaccuacggcaccggcagcuggcccgacggcgccaacaucaacuucaugcccaucuga

SEQ ID NO: 176939 - RNA, 1380 nt, Artificial Sequence
  derived and/or modified sequence opt4 from neuraminidase__InfluenzaA__AHJ57746
augaaccccaaccagaagaucaucaccaucggcagcgugagcaucaccaucgccgccgugugcuuccugaugcagaucgccauccuggccaccaccgugacccugcacuucaagcagaacgagugcaacauccccagcaagaaccacgugauccccugcgagcccaucaucaucgagagaaacaucaccgagguggagaucagacccaagguggccgaguacagagacuggagcaagccccagugccagaucaccggcuucgcccccuucagcaaggacaacagcaucagacugagcgccggcggcaacaucugggugaccagagagcccuacgugagcugcggccccgacaagugcuaccaguucgcccugggccagggcaccacccugggcaacggccacagcaacggcaccauccacgacaagaucccccacagaacccugcugaugaacgagcugggcgugcccuuccaccugggcaccaagcaggugugcaucgccuggagcagcagcagcugccacgacggcagagccuggcugcacgugugcgugaccggcgacgacagaaacgccaccgccagcuucaucuacgacggcaugcugguggacagcaucgccagcuggagccagaacauccugagaacccaggagagcgagugcgugugcaucaacggcaccugcaccguggugaugaccgacggcagcgccagcggcguggccgacaccagaauccuguucaucagagagggcaagaucgugcacaucagcccccugagcggcagcgcccagcacaucgaggagugcagcugcuaccccagacacagcgacgugagaugcgugugcagagacaacuggaagggcagcaacagacccgugguggacaucaacaugaccgacuacagcaucgacagcagcuacgugugcagcggccuggugggcgacacccccagaaacgacgacagcagcagcagcagcaacugcagagaccccaacaacgagagaggcaaccccggcgugaagggcugggccuucgacgacggcgacgacguguggaugggcagaaccaucagcagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 176940 - RNA, 1410 nt, Artificial Sequence
  derived and/or modified sequence opt4 from neuraminidase__InfluenzaA__AHJ57758
augaaccccaaccagaagaucaucaccgugggcagcgugagccuggccaucgccaccaucugccugcugaugcagaucgccauccuggccaccaccgugacccugcacuucaagcagaacgagugcaacauccccagcaagaaccaggugaugcccugcgagcccaucaucaucgagagaaacaucaccgaggugguguaccugaacaacaccaucaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcagccccagcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacgugugcaucaccggcgacgacagaaacgccaccgccagcuucaucuacaacggcaugcugguggacagcaucagcagcuggagcagaaacauccugagaacccaggagagcgagugcgugugcaucaacggcaccugcaccgugaucaugaccgacggcagcgccagcggcguggccgacaccagaauccuguucaucagagagggcaacaucgugcacgugagcccccugagcggcagcgcccagcacaucgaggagugcagcugcuaccccagauaccccgacgugagaugcgugugcagagacaacuggaagggcagcaacagacccgugguggacaucaacauggccgacuacagcaucgacagccacuacgugugcagcggccuggugggcgacacccccagaaacgacgacagcagcagcagcagcaacugcaaggaccccaacaacgagagaggcaaccccggcgugaagggcugggccuucgacgacggcaacgacguguggaugggcagaaccaucagcagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 176941 - RNA, 1401 nt, Artificial Sequence
  derived and/or modified sequence opt4 from neuraminidase__InfluenzaA__AHJ57770
augaaccccaaccagaagaucaucgccaucggcagcgugagccugaccaucgccaucaucugcuuccugaugcagaucgccauccugaccaccaccaugacccugcacuucaagcagaacgagugcagcaaccccagcaacaaccagguggugcccugcgagcccaucaucaucgagagaaacaccgugcaccugaacagcaccaccaucgagaaggagaucugccccaaggugguggaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcguggagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacgacagcagaagcggcuacgagaccuucagaguggugaacggcuggaccaccgccaacagcaagagccagaucaacagacaggugaucguggacagcgagaacuggagcggcuacagcggcaucuucagcguggagggcaagaacugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuuccugcccaucuga

SEQ ID NO: 176942 - RNA, 1410 nt, Artificial Sequence
  derived and/or modified sequence opt4 from neuraminidase__InfluenzaA__AHJ57782
augaaccccaaccagaagaucaucaucaucggcagcgugagccugaccaucgccaccgugugcuuccugaugcagaucgccauccuggccaccaccgugacccugcacuucaagcagaacgagugcaacauccccagcaagaaccagguggugcccugcgagcccaucaucaucgagagaaacaucaccgaggugguguaccugaacaacaccaccaucgagaaggagaucugccccgccgugguggaguacagaaacuggagcaagccccagugccagaucaagggcuucgcccccuucagcaaggacaacagcaucagacugagcgccggcggcgacaugugggugaccagagagcccuacgugagcugcagccccagcaagugcuaccaguucgcccugggccagggcaccacccuggacaacaaccacagcaacggcaccauccacgacagaaucccccacagaacccugcugaugaacgagcugggcgugcccuuccaccugggcaccaagcaggugugcaucgccuggagcagcagcagcugccacgacggcaaggccuggcugcacgugugcgugaccggcgacgacagaaacgccaccgccagcuucaucuacgacggcaugcugguggacagcaucggcagcuggagccagaacauccugagaacccaggagagcgagugcgugugcaucaacggcaccugcaccguggugaugaccgacggcagcgccagcggcaucgccgacaccagaauccuguucgugagagagggcaagaucgugcacaucagcccccugagcggcagcgcccagcacaucgaggagugcagcugcuaccccagauaccccgacgugagaugcgugugcagagacaacuggaagggcagcaacagacccaucguggacaucaacauggccgacuacagcaucggcagcagcuacgugugcagcggccuggugggcgacacccccagaaacgacgacagauucagcagcagcaacugcagagaccccaacagcgagagaggcaaccccggcgugaagggcugggccuucgacgacggcgacgacguguggaugggcagaaccaucagcagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 176943 - RNA, 1410 nt, Artificial Sequence
  derived and/or modified sequence opt4 from neuraminidase__InfluenzaA__AHJ57794
augaaccccaaccagaagaucaucaccgugggcagcgugagccuggccaucgccaccaucugcuuccugaugcagaucgccauccuggccaccaccgugacccugcacuucaagcagaacgagugcaacauccccagcaagaaccaggugaugcccugcgagcccaucaucaucgagagaaacaucaccgaggugguguaccugaacaacaccaucaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcagccccagcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacgugugcaucaccggcgacgacagaaacgccaccgccagcuucaucuacaacggcaugcugguggacagcaucagcagcuggagcagaaacauccugagaacccaggagagcgagugcgugugcaucaacggcaccugcaccgugaucaugaccgacggcagcgccagcggcguggccgacaccagaauccuguucaucagagagggcaacaucgugcacgugagcccccugagcggcagcgcccagcacaucgaggagugcagcugcuaccccagauaccccgacgugagaugcgugugcagagacaacuggaagggcagcaacagacccgugguggacaucaacauggccgacuacagcaucgacagccacuacgugugcagcggccuggugggcgacacccccagaaacgacgacagcagcagcagcagcaacugcaaggaccccaacaacgagagaggcaaccccggcgugaagggcugggccagcgacgacggccacgacguguggaugggcagaaccaucggcagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 176944 - RNA, 1413 nt, Artificial Sequence
  derived and/or modified sequence opt4 from neuraminidase__InfluenzaA__AHJ57806
augaaccccaaccagaagaucaccugcaucagcgccaccggcaugacccugagcguggugagccugcugaccggcaucgccaaccugggccugaacaucggccugcacuacaaggugagcgacagcaccaacaucagcauccccaacaugaacgaggccagccccaccaccaccaucaucaacaaccacccccagaacaacuucaccaacaucaccaacaucaucaugaacaagaacgaggagggcaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcaagaacagcuggcugggcagaaccaucagcaaggacagcagaagcggcuacgagaugcugaaggugcccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176945 - RNA, 1380 nt, Artificial Sequence
  derived and/or modified sequence opt4 from neuraminidase__InfluenzaA__AHJ57818
augaaccccaaccagaagaucaccugcaucagcgccaccggcgugacccugagcguggugagccugcugaucggcaucgccaaccugggccugaacaucggccugcacuacaaggugagcgacagccccaccaucaacauccccaacaugaacgagaccaaccccaucaccaccaacaucaccaacaucaucgugaacaagaacgaggagggcaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggccggcaacauccugagaacccaggagagcgagugcgugugccacaagggcaucugccccguggugaugaccgacggccccgccaacaacaaggccgccaccaagaucaucuacuucaaggagggcaagauccagaagaucgaggagcugcagggcaacgcccagcacaucgaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccgacggcaacugcgacgcccccaucaccggcggcagccccgaccccggcgugaagggcuucgccuuccuggagggcgagaacagcuggcugggcagaaccaucagcaaggacagcagaagcggcuacgagaugcugaaggugcccaacgccgagaccgacacccagagcggcgccaucagccaccagaugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176946 - RNA, 1410 nt, Artificial Sequence
  derived and/or modified sequence opt4 from neuraminidase__InfluenzaA__AHJ57830
augaaccccaaccagaagaucaucaccaucggcagcgugagccugaccaucgccaccgugagcuuccugaugcagaucgccauccugaccaccaccgugacccugcacuucaagcacaacgagugcaacaugccccccaagaaccaggugaugagcugcgagcccaucaucaucgagagaaacaucaccgagaucguguaccugaacaacaccaccaucgagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacaucugcaucaccggcgacgacagaaacgccaccgccagcuucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucgacaucaacauggccgacuacagcaucgacagcaacuacgugugcagcggccuggugggcgacacccccagaaacgacgacaacagcagcagcagcaacugcagagaccccaacaacgagagaggcaaccccggcgugaagggcugggccuucgacgacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagcccagagugugguggaccagcaacagcaucgugguguucugcggcaccagcggcaccuacggcaccggcagcuggcccgacggcgccaacaucaacuucaugcccaucuga

SEQ ID NO: 176947 - RNA, 1413 nt, Artificial Sequence
  derived and/or modified sequence opt4 from neuraminidase__InfluenzaA__AHJ57842
augaaccccaaccagaagaucaccugcaucagcgccaccggcaugacccugagcguggugagcaugcugaucggcaucgccaaccugggccugaacaucggccugcacuacaaggugagcgacagcaccaacaucaacauccccaagaugaacgagaccaaccccaccaccaccaucaucaacaaccacccccagaacaacuucaccaacaucaccaacaucaucgugaacaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccaccaucagaggccagcacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagcagcgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176948 - RNA, 1413 nt, Artificial Sequence
  derived and/or modified sequence opt4 from neuraminidase__InfluenzaA__AHJ57853
augaaccccaaccagaagaucaccugcaucagcgccaccggcaugacccugagcguggugagccugcugaucggcaucgccaaccugggccugaacgugggccugcacuacaaggugaacgaccccaccaacaucaacauccccaacaugaacgagaccagccccaccaccaccaucaucaacaaccacccccagaacaacuucaccaacaucaccaacaucaucgugaacaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggccagcacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176949 - RNA, 1413 nt, Artificial Sequence
  derived and/or modified sequence opt4 from neuraminidase__InfluenzaA__AHJ57865
augaaccccaaccagaagaucaccugcaucagcgccaccggcaugacccugagcguggugagcaugcugaucggcaucgccaaccugggccugaacaucggccugcacuacaaggugagcgacagcaccaacaucaacauccccaagaugaacgagaccaaccccaccaccaccaucaucaacaaccacccccagaacaacuucaccaacaucaccaacaucaucgugaacaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176950 - RNA, 1413 nt, Artificial Sequence
  derived and/or modified sequence opt4 from neuraminidase__InfluenzaA__AHJ57876
augaaccccaaccagaagaucaccugcaucagcgccaccggcaugacccugagcguggugagccugcugaucggcaucgccaaccugggccugaacaucggccugcacuacaaggugagcgacagcaccaacaucaacauccccaacaugaacgagaccagccccaccaccaccaucaucaacaaccacccccagaacaacuucaccaacaucaccaacaucaucaugaacaagaacgaggagggcaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaagagcagaaugagcaucugcaucagcggccccaacaacaacgccagcgccguggugugguacggcggcagacccaucaccgagauccccagcugggccggcaacauccugagaacccaggagagcgagugcgugugccacggcggcaucugccccguggugaugaccgacggccccgccaacaacagagccgagaccaagaucaucuacuucaaggagggcaaggugcagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176951 - RNA, 1413 nt, Artificial Sequence
  derived and/or modified sequence opt4 from neuraminidase__InfluenzaA__AHJ57888
augaaccccaaccagaagaucaccugcaucagcgccaccggcaugacccugagcguggugagcaugcugaucggcaucgccaaccugggccugaacaucggccugcacuacaaggugagcgacagcaccaacaucaacauccccaacaugaacgagaccagccccaccaccaccaucaccaacaaccacccccagaacaacuucaccaacaucaccaacaucaucgugagcaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggccagcacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176952 - RNA, 1413 nt, Artificial Sequence
  derived and/or modified sequence opt4 from neuraminidase__InfluenzaA__AHJ57900
augaaccccaaccagaagaucaccugcaucagcgccaccggcaugacccugagcguggugagccugcugaucggcaucgccaaccugggccugaacaucggccugcacuacaaggugagcgacagcaccaacaucaacauccccaacaugaacgagaccagccccaccgccaccaucaucaacaaccacccccagaacaacuucaccaacaucaccaacaucaucgugaacaagaacgaggaggagaacuucuucaaccuggccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggccagcacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggaccugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176953 - RNA, 1413 nt, Artificial Sequence
  derived and/or modified sequence opt4 from neuraminidase__InfluenzaA__AHJ57911
augaaccccaaccagaagaucaccugcaucagcgccaccggcgugacccugagcguggugagccugcugaucggcaucgccaaccugggccugaacaucggccugcacuacaaggugagcgacagcagcaacaucaacauccccaacaugaacgagaccaaccccaccaccaccaucaucaacaaccacacccagaacaacuucaagaacaucaccaacaucaucgugaacaagaacgaggagggcaucuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacagaggcagacccgugaccgagauccccagcugggccggcaacauccugagaacccaggagagcgagugcgugugccacaagggcaucugccccguggugaugaccgacggccccgccaacaacagagccgccaccaagaucaucuacuucaaggagggcaagauccagaagaucgaggagcugaagggcaacgcccagcacaucgaggagugcagcugcuacggcgccgccggcaugaucaagugcaucugcagagacaacuggagaggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcagcaccagcuaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176954 - RNA, 1410 nt, Artificial Sequence
  derived and/or modified sequence opt4 from neuraminidase__InfluenzaA__AHJ57923
augaaccccaaccagaagaucaucaccgugggcagcgugagccuggccaucgccaccaucugcuuccugaugcagaucgccauccuggccaccaccgugacccugcacuucaagcagaacgagugcaacauccccagcaagaaccaggugaugcccugcgagcccaucaucaucgagagaaacaucaccgaggugguguaccugaacaacaccaucaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcagccccagcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacgugugcaucaccggcgacgacagaaacgccaccgccagcuucaucuacaacggcaugcugguggacagcaucagcagcuggagcagaaacauccugagaacccaggagagcgagugcgugugcaucaacggcaccugcaccgugaucaugaccgacggcagcgccagcggcguggccgacaccagaauccuguucaucagagagggcaagaucgugcacgugagcccccugagcggcagcgcccagcacaucgaggagugcagcugcuaccccagauaccccgacgugagaugcgugugcagagacaacuggaagggcagcaacagacccgugguggacaucaacauggccgacuacagcaucgacagccacuacgugugcagcggccuggugggcgacacccccagaaacgacgacagcagcagcagcagcaacugcaaggaccccaacaacgagagaggcaaccccggcgugaagggcugggccuucgacgacggcaacgacguguggaugggcagaaccaucagcagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 176955 - RNA, 1380 nt, Artificial Sequence
  derived and/or modified sequence opt4 from neuraminidase__InfluenzaA__AHJ57935
augaaccccaaccagaagaucaccugcaucagcgccaccggcgugacccugagcguggugagccugcugaucggcaucgccaaccugggccugaacaucggccugcacuacaaggugagcgacagccccaccaucaacauccccaacaugaacgagaccaaccccaccaccaccaacaucaccaacaucaucgugaacaagaacgaggagggcaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggccggcaacauccugagaacccaggagagcgagugcgugugccacaagggcaucugccccguggugaugaccgacggccccgccaacaacaaggccgccaccaagaucaucuacuucaaggagggcaagauccagaagaucgaggagcugcagggcaacgcccagcacaucgaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgcccagaccgacacccagagcggccccaccagcuaccagcugaucgugaacaaccagaacuggagcggcuacagcggcgccuucaucgacuacugggccaacaaggagugcuucaaccccugcuucuacguggagcugaucagaggcagacccaaggagagcaacgugcuguggaccagcaacagcaugguggcccugugcggcagcagagagagacugggcagcuggagcuggcacgacgacgccgagaucaucuacuucaaguga

SEQ ID NO: 176956 - RNA, 1410 nt, Artificial Sequence
  derived and/or modified sequence opt4 from neuraminidase__InfluenzaA__AHJ57946
augaaccccaaccagaagaucaucaccaucggcagcgugagccugaccaucgccaccgugagcuuccugaugcagaucgccauccugaccaccaccgugacccugcacuucaagcacaacgagugcaacaugccccccaagaaccaggugaugagcugcgagcccaucaucaucgagagaaacaucaccgagaucguguaccugaacaacaccaccguggagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacaucugcaucaccggcgacgacagaaacgccaccgccagcuucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucgacaucaacauggccgacuacagcaucgacagccacuacgugugcagcggccuggugggcgacacccccagaaacgacgacaacagcagcagcagcaacugcagagaccccaacaacgagagaggcaaccccggcgugaagggcugggccuucgacgacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagcccagagugugguggaccagcaacagcaucgugguguucugcggcaccagcggcaccuacggcaccggcagcuggcccgacggcgccaacaucaacuucaugcccaucuga

SEQ ID NO: 176957 - RNA, 1410 nt, Artificial Sequence
  derived and/or modified sequence opt4 from neuraminidase__InfluenzaA__AHJ57957
augaaccccaaccagaagaucaucaccaucggcagcgugagccugaccaucgccaccgugagcuuccugaugcagaucgccauccugaccaccaccgugacccugcacuucaagcagaacgagugcaacaugccccccaagaaccaggugaugagcugcgagcccaucaucaucgagagaaacaucaccgagaucguguaccugaacaacaccaccguggagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacaucugcaucaccggcgacgacagaaacgccaccgccagcuucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucgacaucaacauggccgacuacagcaucgacagcaacuacgugugcagcggccuggugggcgacacccccagaaacgacgacaacagcagcagcagcaacugcagagaccccaacaacgagagaggcaaccccggcgugaagggcugggccuucgacuacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagcccagagugugguggaccagcaacagcaucgugguguucugcggcaccagcggcaccuacggcaccggcagcuggcccgacggcgccaacaucaacuucaugcccaucuga

SEQ ID NO: 176958 - RNA, 1410 nt, Artificial Sequence
  derived and/or modified sequence opt4 from neuraminidase__InfluenzaA__AHJ57968
augaaccccaaccagaagaucaucaccgugggcagcgugagccuggccaucgccaccaucugccugcugaugcagaucgccauccuggccaccaccgugacccugcacuucaagcagaacgagugcaacauccccagcaagaaccaggugaugcccugcgagcccaucaucaucgagagaaacaucaccgaggugguguaccugaacaacaccaucaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcagccccagcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacgugugcaucaccggcgacgacagaaacgccaccgccagcuucaucuacaacggcaugcugguggacagcaucagcagcuggagcagaaacauccugagaacccaggagagcgagugcgugugcaucaacggcaccugcaccgugaucaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucgacaucaacauggccgacuacagcaucgacagcaacuacgugugcagcggccuggugggcgacacccccagaaacgacgacaacagcagcagcagcaacugcagagaccccaacaacgagagaggcaaccccggcgugaagggcugggccuucgacgacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagaccagagugugguggaccagcaacagcaucgugguguucugcggcaccagcugcaccuacggcaccggcagcuggcccgacggcgccaacaucaacuucaugcccaucuga

SEQ ID NO: 176959 - RNA, 1413 nt, Artificial Sequence
  derived and/or modified sequence opt4 from neuraminidase__InfluenzaA__AHJ57980
augaaccccaaccagaagaacaccugcaucagcgccaucggcaugacccugagcguggugagccugcugaucggcguggccgaccugggccugaacaucggccugcacuacaaggugagcgacagcagcaacaucaacauccccaacaugaacgagaccaaccccaccaccaccaucaucaacaacaacccccagaacaacuucaccaacaucaccaacaucaucgugaacaagaacgaggaggagaaguuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacaagggcaucugccccguggugaugaccgacggccccgccaacaacagagccgccaccaagaucaucuacuucaaggagggcaagauccagaagaucgaggagcugaagggcaacgcccagcacaucgaggagugcagcugcuacggcgccgccggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccagcggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaucagcuaccagaccaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176960 - RNA, 1410 nt, Artificial Sequence
  derived and/or modified sequence opt4 from neuraminidase__InfluenzaA__AHJ57992
augaaccccaaccagaagaucaucaccaucggcagcgugagccugaccaucgccaccgugagcuuccugaugcagaucgccauccugaccaccaccgugacccugcacuucaagcacaacgagugcaacaugccccccaagaaccaggugaugagcugcgagcccaucaucaucgagagaaacaucaccgagaucguguaccugaacaacaccaccguggagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacaucugcaucaccggcgacgacagaaacgccaccgccagcuucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucaacaucaacauggccgacuacagcaucgacagcaacuacgugugcagcggccuggugggcgacacccccagaaacgacgacaacagcagcagcagcaacugcagagaccccaacaacgagagaggcaaccccggcgugaagggcugggccuucgacgacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagcccagagugugguggaccagcaacagcaucgugguguucugcggcaccagcggcaccuacggcaccggcagcuggcccgacggcgccaacaucaacuucaugcccaucuga

SEQ ID NO: 176961 - RNA, 1413 nt, Artificial Sequence
  derived and/or modified sequence opt4 from neuraminidase__InfluenzaA__AHJ58004
augaaccccaaccagaagaucaccugcaucagcgccaccggcgugacccugagcguggugagccugcugaucggcaucgccaaccugggccugaacaucggccugcacuacaaggugagcgacagcagcaacaucaacauccccaacaugaacgagaccaaccccaccaccaccaucaucaacaaccacacccagaacaacuucaagaacaucaccaacaucaucgugaacaagaacgaggagggcaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacagaggcagacccgugaccgagauccccagcugggccggcaacauccugagaacccaggagagcgagugcgugugccacaagggcaucugccccguggugaugaccgacggccccgccaacaacagagccgccaccaagaucaucuacuucaaggagggcaagauccagaagaucgaggagcugaagggcaacgcccagcacaucgaggagugcagcugcuacggcgccgccggcaugaucaagugcaucugcagagacaacuggagaggcgccaacagacccgugaucaccaucgaccccgagaugaugacccacaccagcaaguaccugugcagcaagauccugaccgacaccagcagacccaacgaccccaccaacggcaacugcgacgagcccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagcuaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176962 - RNA, 1413 nt, Artificial Sequence
  derived and/or modified sequence opt4 from neuraminidase__InfluenzaA__AHJ58016
augaaccccaaccagaagaucaccugcaucagcgccaccggcaugacccugagcguggugagcaugcugaucggcaucgccaaccugggccugaacaucggccugcacuacaaggugagcgacagcaccaacaucaacauccccaagaugaacgagaccaaccccaccaccaccaucaucaacaaccacccccagaacaacuucaccaacaucaccaacaucaucgugaacaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcaagaacagcuggcugggcagaaccaucagcaaggacagcagaagcggcuacgagaugcugaaggugcccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuaccugaaguga

SEQ ID NO: 176963 - RNA, 1413 nt, Artificial Sequence
  derived and/or modified sequence opt4 from neuraminidase__InfluenzaA__AHJ58028
augaaccccaaccagaagaucaccugcaucagcgccaccggcaugacccugagcguggugagcaugcugaucggcaucgccaaccugggccugaacaucggccugcacuacaaggugagcgacagcaccaacaucaacauccccaagaugaacgagaccaaccccaccaccaccaucaucaacaaccacccccagaacaacuucaccaacaucaccaacaucaucgugaacaagaacgaggaggagaacuuccugaaccugaccaagccccugugcgaggugaacagcuggcacauccugagcaaggacaacgccgugagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggccggcaacauccugagaacccaggagagcgagugcgugugccacaagggcaucugccccguggugaugaccgacggccccgccaacaacagagccgagaccaagaucaucuacuucaaggagggcaagauccagaagaucgaggagcuggagggcaacgcccagcacaucgaggagugcagcugcuacggcaccgccggcaugaucaagugcaucugcagagacaacuggagaggcgccaacagacccgugaucaccaucgaccccgagaugaugacccacaccagcagauaccugugcagcaagauccugaccgacaccagcagacccaacgaccccaccaacggcaacugcgacgcccccaucaccggcggcagccccgaccccggcgugaagggcuucgccuuccuggacggcaagaacagcuggcugggcagaaccaucagcaaggacagcagaagcggcuacgagaugcugaaggugcccaacgccgagaccgacauccagagcggccccaccagcaaccagaucaucgugaacaaccagaacuggagcggcuacagcggcgccuucaucgacuacugggccaacaaggagugcuucaaccccugcuucuacguggagcugaucagaggcagacccaaggagagcaacgugcuguggaccagcaacagcaucguggcccugugcggcagcagagagagacugggcagcuggagcuggcacgacggcgccgagaucaucuacuucaaguga

SEQ ID NO: 176964 - RNA, 1410 nt, Artificial Sequence
  derived and/or modified sequence opt4 from neuraminidase__InfluenzaA__AHJ58040
augaaccccaaccagaagaucaucaccgugggcagcgugagccuggccaucgccaccaucugccugcugaugcagaucgccauccuggccaccaccgugacccugcacuucaagcagaacgagugcaacauccccagcaagaaccaggugaugcccugcgagcccaucaucaucgagagaaacaucaccgaggugguguaccugaacaacaccaucaucgagaaggagaucugccccaaggugguggaguacagaaacuggagcaagccccagugccagaucaccggcuucgcccccuucagcaaggacaacagcaucagacugagcgccggcggcgacaucugggugaccagagagcccuacgugagcugcagccccagcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacgugugcaucaccggcgacgacagaaacgccaccgccagcuucaucuacaacggcaugcugguggacagcaucagcagcuggagcagaaacauccugagaacccaggagagcgagugcgugugcaucaacggcaccugcaccgugaucaugaccgacggcagcgccagcggcguggccgacaccagaauccuguucaucagagagggcaagaucgugcacgugagcccccugagcggcagcgcccagcacaucgaggagugcagcugcuaccccagauaccccgacgugagaugcgugugcagagacaacuggaagggcagcaacagacccgugguggacaucaacauggccgacuacagcaucgacagccacuacgugugcagcggccuggugggcgacacccccagaaacgacgacagcagcagcagcagcaacugcaaggaccccaacaacgagagaggcaaccccggcgugaagggcugggccuucgacgacggcaacgacguguggaugggcagaaccaucagcagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 176965 - RNA, 1410 nt, Artificial Sequence
  derived and/or modified sequence opt4 from neuraminidase__InfluenzaA__AHJ58052
augaaccccaaccagaagaucaucaccaucggcagcgugagccugaccaucgccaccgugagcuuccugaugcagaucgccauccugaccaccaccgugacccugcacuucaagcacaacgagugcaacaugccccccaagaaccaggugaugagcugcgagcccaucaucaucgagagaaacaucaccgagaucguguaccugaacaacaccaccguggagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggacaacagccacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacaucugcaucaccggcgacgacagaaacgccaccgccagcuucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagaauccuguucaucagagagggcaagaucgugcacaucagcccccugagcggcagcgcccagcacaucgaggagugcagcugcuaccccagauaccccgacgugagaugcgugugcagagacaacuggaagggcagcaacagacccgugaucgacaucaacauggccgacuacagcaucgacagcaacuacgugugcagcggccuggugggcgacacccccagaaacgacgacaacagcagcagcagcaacugcagagaccccaacaacgagagaggcaaccccggcgugaagggcugggccuucgacgacggcaacgacguguggaugggcagaaccaucaacagagacagcagaagcggcuacgagaccuucagagugaucggcggcuggaccaccgccaacagcaagagccagaucaacagacaggugaucguggacaacaacaacuggagcggcuacagcggcguguucagcguggagggcaagagcugcaucaacagaugcuucuacguggagcugaucagaggcagaccccaggagcccagagugugguggaccagcaacagcaucgugguguucugcggcaccagcggcaccuacggcaccggcagcuggcccgacggcgccaacaucaacuucaugcccaucuga

SEQ ID NO: 176966 - RNA, 1413 nt, Artificial Sequence
  derived and/or modified sequence opt4 from neuraminidase__InfluenzaA__AHJ58064
augaaccccaaccagaagaucaccugcaucagcgccaccggcaugacccugagcguggugagccugcugaucggcaucgccaaccugggccugaacaucggccugcacuacaaggugagcgacagcaccaacaucaacauccccaacaugaacgagaccagccccaccaccaccaucaucaacaaccacccccagaacaacuucaccaacaucaccaacaucaucgugaacaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggccagcacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaucaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176967 - RNA, 1401 nt, Artificial Sequence
  derived and/or modified sequence opt4 from neuraminidase__InfluenzaA__AHJ58075
augaaccccaaccagaagaucaucgccaucggcagcgugagccugaccaucgccaucaucugcuuccugcugcagaucgccauccugaccaccaccaugacccugcacuucagacagaacgagugcagcaaccccagcaacaaccagguggugcccugcgagcccaucaucaucgagagaaacaccgugcaccugaacagcaccaccaucgagaaggagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccugggcaagugcuaccaguucgcccugggccagggcaccacccugaagaacaagcacagcaacggcaccacccacgacagaaucccccacagaacccugcugaugaacgagcugggcgugcccuuccaccugggcaccaagcaggugugcaucgccuggagcagcagcagcugccacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagaauccuguucaucagagagggcaagaucaucaacaucagcccccugagcggcagcgcccagcacguggaggagugcagcugcuaccccagauaccccgaggugagaugcgugugcagagacaacuggaagggcagcaacagacccgugcuguacaucaacauggccgacuacagcaucgagagcagcuacgugugcagcggccuggugggcgacacccccagagacgacgacagcagcagcagcagcaacugcagagaccccaacaacgagagaggcgcccccggcgugaagggcugggccuucgacgacggcaacgacaucuggaugggcagaaccaucaagagcgacagcagaagcggcuacgagaccuucagaguggugaacggcuggaccaccgccaacagcaagagccagaucaacagacaggugaucguggacagcgacagcuggagcggcuacagcggcaucuucagcguggagggcaagaacugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugcccaucuga

SEQ ID NO: 176968 - RNA, 1413 nt, Artificial Sequence
  derived and/or modified sequence opt4 from neuraminidase__InfluenzaA__AHJ58087
augaaccccaaccagaagaucaccugcaucagcgccaccggcaugacccugagcguggugagccugcugaucggcaucgccaaccugggccugaacaucggccugcacuacaaggugagcgacagcaccaacaucaacauccccaacaugaacgagaccagccccaccaccaccaucaucaacaaccacccccagaacaacuucaccaacaucaccaacaucaucgugaacaagaacgaggaggagaacuuccugaaccugaccaagccccugugcgaggugaacagcuggcacauccugagcaaggacaacgccaucagaaucggcgagaacgcccacauccuggugaccagagagcccuaccugagcugcgacccccagggcugcagaauguucgcccugagccagggcaccacccugagaggccagcacgccaacggcaccauccacgacagaagccccuucagagcccugaucagcugggagaugggccaggcccccagccccuacaacgccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagauccagaagaucgaggagcugaagggcaacgcccagcacaucgaggagugcagcugcuacggcgccagcggcaugaucaagugcaucugcagagacaacuggaagggcgccaacagacccgugaucaccaucgaccccgagaugaugacccacaccagcaaguaccugugcagcaagauccugaccgacaccagcagacccaacgaccccaucaacggcaacugcgacgcccccaucaccggcggcagccccgaccccggcgugaagggcuucgccuuccuggacggcgacaacagcuggcugggcagaaccaucagcaaggacagcagaagcggcuacgagaugcugaaggugcccaacgccgagaccgacacccagagcggcgccaucagccaccagaugaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcagagagagacugggcagcuggagcuggcacgacggcgccgagaucaucuacuucaaguga

SEQ ID NO: 176969 - RNA, 1410 nt, Artificial Sequence
  derived and/or modified sequence opt4 from neuraminidase__InfluenzaA__AHL80721
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacguggugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176970 - RNA, 1410 nt, Artificial Sequence
  derived and/or modified sequence opt4 from neuraminidase__InfluenzaA__AHL80732
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaucaucgacaaguga

SEQ ID NO: 176971 - RNA, 1410 nt, Artificial Sequence; identical to SEQ ID NO: 169258
  derived and/or modified sequence opt4 from neuraminidase__InfluenzaA__AHL80743

SEQ ID NO: 176972 - RNA, 1410 nt, Artificial Sequence
  derived and/or modified sequence opt4 from neuraminidase__InfluenzaA__AHL80754
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176973 - RNA, 1410 nt, Artificial Sequence; identical to SEQ ID NO: 169258
  derived and/or modified sequence opt4 from neuraminidase__InfluenzaA__AHL80765

SEQ ID NO: 176974 - RNA, 1410 nt, Artificial Sequence; identical to SEQ ID NO: 169258
  derived and/or modified sequence opt4 from neuraminidase__InfluenzaA__AHL80776

SEQ ID NO: 176975 - RNA, 1410 nt, Artificial Sequence; identical to SEQ ID NO: 169258
  derived and/or modified sequence opt4 from neuraminidase__InfluenzaA__AHL80787

SEQ ID NO: 176976 - RNA, 1410 nt, Artificial Sequence
  derived and/or modified sequence opt4 from neuraminidase__InfluenzaA__AHL80798
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcgugaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176977 - RNA, 1410 nt, Artificial Sequence; identical to SEQ ID NO: 169258
  derived and/or modified sequence opt4 from neuraminidase__InfluenzaA__AHL80809

SEQ ID NO: 176978 - RNA, 1410 nt, Artificial Sequence; identical to SEQ ID NO: 169258
  derived and/or modified sequence opt4 from neuraminidase__InfluenzaA__AHL80820

SEQ ID NO: 176979 - RNA, 1410 nt, Artificial Sequence; identical to SEQ ID NO: 169258
  derived and/or modified sequence opt4 from neuraminidase__InfluenzaA__AHL80831

SEQ ID NO: 176980 - RNA, 1410 nt, Artificial Sequence; identical to SEQ ID NO: 169258
  derived and/or modified sequence opt4 from neuraminidase__InfluenzaA__AHL80842

SEQ ID NO: 176981 - RNA, 1410 nt, Artificial Sequence; identical to SEQ ID NO: 170546
  derived and/or modified sequence opt4 from neuraminidase__InfluenzaA__AHL80853

SEQ ID NO: 176982 - RNA, 1410 nt, Artificial Sequence
  derived and/or modified sequence opt4 from neuraminidase__InfluenzaA__AHL80864
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176983 - RNA, 1410 nt, Artificial Sequence; identical to SEQ ID NO: 170546
  derived and/or modified sequence opt4 from neuraminidase__InfluenzaA__AHL80875

SEQ ID NO: 176984 - RNA, 1410 nt, Artificial Sequence; identical to SEQ ID NO: 170546
  derived and/or modified sequence opt4 from neuraminidase__InfluenzaA__AHL80886

SEQ ID NO: 176985 - RNA, 1410 nt, Artificial Sequence
  derived and/or modified sequence opt4 from neuraminidase__InfluenzaA__AHL80897
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcaucaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176986 - RNA, 1410 nt, Artificial Sequence
  derived and/or modified sequence opt4 from neuraminidase__InfluenzaA__AHL80908
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaccauccacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaagggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176987 - RNA, 1410 nt, Artificial Sequence
  derived and/or modified sequence opt4 from neuraminidase__InfluenzaA__AHL80919
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaccggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176988 - RNA, 1410 nt, Artificial Sequence; identical to SEQ ID NO: 172038
  derived and/or modified sequence opt4 from neuraminidase__InfluenzaA__AHL80930

SEQ ID NO: 176989 - RNA, 1410 nt, Artificial Sequence; identical to SEQ ID NO: 172038
  derived and/or modified sequence opt4 from neuraminidase__InfluenzaA__AHL80949

SEQ ID NO: 176990 - RNA, 1410 nt, Artificial Sequence
  derived and/or modified sequence opt4 from neuraminidase__InfluenzaA__AHL80961
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacguggugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 176991 - RNA, 1410 nt, Artificial Sequence; identical to SEQ ID NO: 176990
  derived and/or modified sequence opt4 from neuraminidase__InfluenzaA__AHL80972

SEQ ID NO: 176992 - RNA, 1410 nt, Artificial Sequence; identical to SEQ ID NO: 172038
  derived and/or modified sequence opt4 from neuraminidase__InfluenzaA__AHL80983

SEQ ID NO: 176993 - RNA, 1410 nt, Artificial Sequence; identical to SEQ ID NO: 172038
  derived and/or modified sequence opt4 from neuraminidase__InfluenzaA__AHL80992

SEQ ID NO: 176994 - RNA, 1410 nt, Artificial Sequence; identical to SEQ ID NO: 172038
  derived and/or modified sequence opt4 from neuraminidase__InfluenzaA__AHL81004

SEQ ID NO: 176995 - RNA, 1410 nt, Artificial Sequence
  derived and/or modified sequence opt4 from neuraminidase__InfluenzaA__AHL81016
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgacagcgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 176996 - RNA, 1410 nt, Artificial Sequence; identical to SEQ ID NO: 172038
  derived and/or modified sequence opt4 from neuraminidase__InfluenzaA__AHL81028

SEQ ID NO: 176997 - RNA, 1410 nt, Artificial Sequence; identical to SEQ ID NO: 172038
  derived and/or modified sequence opt4 from neuraminidase__InfluenzaA__AHL81040

SEQ ID NO: 176998 - RNA, 1410 nt, Artificial Sequence; identical to SEQ ID NO: 172038
  derived and/or modified sequence opt4 from neuraminidase__InfluenzaA__AHL81052

SEQ ID NO: 176999 - RNA, 1410 nt, Artificial Sequence; identical to SEQ ID NO: 176990
  derived and/or modified sequence opt4 from neuraminidase__InfluenzaA__AHL81064

SEQ ID NO: 177000 - RNA, 1410 nt, Artificial Sequence; identical to SEQ ID NO: 176990
  derived and/or modified sequence opt4 from neuraminidase__InfluenzaA__AHL81075

SEQ ID NO: 177001 - RNA, 1410 nt, Artificial Sequence
  derived and/or modified sequence opt4 from neuraminidase__InfluenzaA__AHL81086
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcaagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177002 - RNA, 1410 nt, Artificial Sequence
  derived and/or modified sequence opt4 from neuraminidase__InfluenzaA__AHL81098
augaaccccaaccagaagaucaucaccaucggcagcgugagccugaccaucagcaccaucugcuucuucgugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177003 - RNA, 1410 nt, Artificial Sequence; identical to SEQ ID NO: 173229
  derived and/or modified sequence opt4 from neuraminidase__InfluenzaA__AHL81110

SEQ ID NO: 177004 - RNA, 1410 nt, Artificial Sequence; identical to SEQ ID NO: 173229
  derived and/or modified sequence opt4 from neuraminidase__InfluenzaA__AHL81121

SEQ ID NO: 177005 - RNA, 1410 nt, Artificial Sequence; identical to SEQ ID NO: 172038
  derived and/or modified sequence opt4 from neuraminidase__InfluenzaA__AHL81132

SEQ ID NO: 177006 - RNA, 1410 nt, Artificial Sequence; identical to SEQ ID NO: 172038
  derived and/or modified sequence opt4 from neuraminidase__InfluenzaA__AHL81144

SEQ ID NO: 177007 - RNA, 1410 nt, Artificial Sequence; identical to SEQ ID NO: 172038
  derived and/or modified sequence opt4 from neuraminidase__InfluenzaA__AHL81156

SEQ ID NO: 177008 - RNA, 1410 nt, Artificial Sequence; identical to SEQ ID NO: 174307
  derived and/or modified sequence opt4 from neuraminidase__InfluenzaA__AHL81168

SEQ ID NO: 177009 - RNA, 1410 nt, Artificial Sequence; identical to SEQ ID NO: 174307
  derived and/or modified sequence opt4 from neuraminidase__InfluenzaA__AHL81180

SEQ ID NO: 177010 - RNA, 1410 nt, Artificial Sequence; identical to SEQ ID NO: 172038
  derived and/or modified sequence opt4 from neuraminidase__InfluenzaA__AHL81192

SEQ ID NO: 177011 - RNA, 1410 nt, Artificial Sequence
  derived and/or modified sequence opt4 from neuraminidase__InfluenzaA__AHL81215
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucauguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaacuucaugcccaucuga

SEQ ID NO: 177012 - RNA, 1410 nt, Artificial Sequence
  derived and/or modified sequence opt4 from neuraminidase__InfluenzaA__AHL81227
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaccggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177013 - RNA, 1410 nt, Artificial Sequence; identical to SEQ ID NO: 172038
  derived and/or modified sequence opt4 from neuraminidase__InfluenzaA__AHL81238

SEQ ID NO: 177014 - RNA, 1410 nt, Artificial Sequence; identical to SEQ ID NO: 172038
  derived and/or modified sequence opt4 from neuraminidase__InfluenzaA__AHL81250

SEQ ID NO: 177015 - RNA, 1410 nt, Artificial Sequence; identical to SEQ ID NO: 172038
  derived and/or modified sequence opt4 from neuraminidase__InfluenzaA__AHL81262

SEQ ID NO: 177016 - RNA, 1410 nt, Artificial Sequence; identical to SEQ ID NO: 172038
  derived and/or modified sequence opt4 from neuraminidase__InfluenzaA__AHL81274

SEQ ID NO: 177017 - RNA, 1410 nt, Artificial Sequence; identical to SEQ ID NO: 172038
  derived and/or modified sequence opt4 from neuraminidase__InfluenzaA__AHL81286

SEQ ID NO: 177018 - RNA, 1410 nt, Artificial Sequence; identical to SEQ ID NO: 172038
  derived and/or modified sequence opt4 from neuraminidase__InfluenzaA__AHL81298

SEQ ID NO: 177019 - RNA, 1410 nt, Artificial Sequence; identical to SEQ ID NO: 176990
  derived and/or modified sequence opt4 from neuraminidase__InfluenzaA__AHL81310

SEQ ID NO: 177020 - RNA, 1410 nt, Artificial Sequence; identical to SEQ ID NO: 173229
  derived and/or modified sequence opt4 from neuraminidase__InfluenzaA__AHL81332

SEQ ID NO: 177021 - RNA, 1410 nt, Artificial Sequence
  derived and/or modified sequence opt4 from neuraminidase__InfluenzaA__AHL81343
augaaccccaaccagaagaucaucaccaucggcagcgugagccugaccaucagcaccaucugcuuccugaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaucaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugcagcgaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177022 - RNA, 1410 nt, Artificial Sequence; identical to SEQ ID NO: 172038
  derived and/or modified sequence opt4 from neuraminidase__InfluenzaA__AHL81355

SEQ ID NO: 177023 - RNA, 1410 nt, Artificial Sequence; identical to SEQ ID NO: 173229
  derived and/or modified sequence opt4 from neuraminidase__InfluenzaA__AHL81367

SEQ ID NO: 177024 - RNA, 1410 nt, Artificial Sequence; identical to SEQ ID NO: 173229
  derived and/or modified sequence opt4 from neuraminidase__InfluenzaA__AHL81378

SEQ ID NO: 177025 - RNA, 1410 nt, Artificial Sequence; identical to SEQ ID NO: 173229
  derived and/or modified sequence opt4 from neuraminidase__InfluenzaA__AHL81389

SEQ ID NO: 177026 - RNA, 1410 nt, Artificial Sequence; identical to SEQ ID NO: 172038
  derived and/or modified sequence opt4 from neuraminidase__InfluenzaA__AHL81400

SEQ ID NO: 177027 - RNA, 1410 nt, Artificial Sequence; identical to SEQ ID NO: 177011
  derived and/or modified sequence opt4 from neuraminidase__InfluenzaA__AHL81412

SEQ ID NO: 177028 - RNA, 1410 nt, Artificial Sequence; identical to SEQ ID NO: 169258
  derived and/or modified sequence opt4 from neuraminidase__InfluenzaA__AHL81422

SEQ ID NO: 177029 - RNA, 1410 nt, Artificial Sequence; identical to SEQ ID NO: 170546
  derived and/or modified sequence opt4 from neuraminidase__InfluenzaA__AHL81433

SEQ ID NO: 177030 - RNA, 1410 nt, Artificial Sequence
  derived and/or modified sequence opt4 from neuraminidase__InfluenzaA__AHL88954
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagagacaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177031 - RNA, 1410 nt, Artificial Sequence
  derived and/or modified sequence opt4 from neuraminidase__InfluenzaA__AHL89033
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggaggacaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177032 - RNA, 1410 nt, Artificial Sequence
  derived and/or modified sequence opt4 from neuraminidase__InfluenzaA__AHL89045
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagacaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177033 - RNA, 1410 nt, Artificial Sequence
  derived and/or modified sequence opt4 from neuraminidase__InfluenzaA__AHL89057
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177034 - RNA, 1410 nt, Artificial Sequence; identical to SEQ ID NO: 168227
  derived and/or modified sequence opt4 from neuraminidase__InfluenzaA__AHL89069

SEQ ID NO: 177035 - RNA, 1410 nt, Artificial Sequence; identical to SEQ ID NO: 167232
  derived and/or modified sequence opt4 from neuraminidase__InfluenzaA__AHL89081

SEQ ID NO: 177036 - RNA, 1410 nt, Artificial Sequence; identical to SEQ ID NO: 167232
  derived and/or modified sequence opt4 from neuraminidase__InfluenzaA__AHL89093

SEQ ID NO: 177037 - RNA, 1410 nt, Artificial Sequence; identical to SEQ ID NO: 167232
  derived and/or modified sequence opt4 from neuraminidase__InfluenzaA__AHL89117

SEQ ID NO: 177038 - RNA, 1410 nt, Artificial Sequence; identical to SEQ ID NO: 167232
  derived and/or modified sequence opt4 from neuraminidase__InfluenzaA__AHL89129

SEQ ID NO: 177039 - RNA, 1410 nt, Artificial Sequence
  derived and/or modified sequence opt4 from neuraminidase__InfluenzaA__AHL89141
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177040 - RNA, 1410 nt, Artificial Sequence
  derived and/or modified sequence opt4 from neuraminidase__InfluenzaA__AHL89153
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucagccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177041 - RNA, 1410 nt, Artificial Sequence; identical to SEQ ID NO: 167232
  derived and/or modified sequence opt4 from neuraminidase__InfluenzaA__AHL89165

SEQ ID NO: 177042 - RNA, 1410 nt, Artificial Sequence
  derived and/or modified sequence opt4 from neuraminidase__InfluenzaA__AHL89177
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaacgagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 177043 - RNA, 1410 nt, Artificial Sequence; identical to SEQ ID NO: 169084
  derived and/or modified sequence opt4 from neuraminidase__InfluenzaA__AHL89189

SEQ ID NO: 177044 - RNA, 1410 nt, Artificial Sequence; identical to SEQ ID NO: 168227
  derived and/or modified sequence opt4 from neuraminidase__InfluenzaA__AHL89201

SEQ ID NO: 177045 - RNA, 1410 nt, Artificial Sequence; identical to SEQ ID NO: 169084
  derived and/or modified sequence opt4 from neuraminidase__InfluenzaA__AHL89213

SEQ ID NO: 177046 - RNA, 1410 nt, Artificial Sequence
  derived and/or modified sequence opt4 from neuraminidase__InfluenzaA__AHL89225
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177047 - RNA, 1410 nt, Artificial Sequence; identical to SEQ ID NO: 169084
  derived and/or modified sequence opt4 from neuraminidase__InfluenzaA__AHL89237

SEQ ID NO: 177048 - RNA, 1410 nt, Artificial Sequence; identical to SEQ ID NO: 168227
  derived and/or modified sequence opt4 from neuraminidase__InfluenzaA__AHL89261

SEQ ID NO: 177049 - RNA, 1410 nt, Artificial Sequence
  derived and/or modified sequence opt4 from neuraminidase__InfluenzaA__AHL89273
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 177050 - RNA, 1410 nt, Artificial Sequence
  derived and/or modified sequence opt4 from neuraminidase__InfluenzaA__AHL89285
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcagcaccagcggcaccuacggcaccggcagcuggcccgacggcgccgacaucaaccugaugcccaucuga

SEQ ID NO: 177051 - RNA, 1410 nt, Artificial Sequence; identical to SEQ ID NO: 177049
  derived and/or modified sequence opt4 from neuraminidase__InfluenzaA__AHL89297

SEQ ID NO: 177052 - RNA, 1410 nt, Artificial Sequence; identical to SEQ ID NO: 177049
  derived and/or modified sequence opt4 from neuraminidase__InfluenzaA__AHL89309

SEQ ID NO: 177053 - RNA, 1410 nt, Artificial Sequence
  derived and/or modified sequence opt4 from neuraminidase__InfluenzaA__AHL89321
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177054 - RNA, 1410 nt, Artificial Sequence
  derived and/or modified sequence opt4 from neuraminidase__InfluenzaA__AHL89333
augaaccccaaccagaagaucaucaccaucggcagcgugagccugaccaucagcaccaucugcuucuucaugcagaucgccauccugaucgccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177055 - RNA, 1410 nt, Artificial Sequence; identical to SEQ ID NO: 167232
  derived and/or modified sequence opt4 from neuraminidase__InfluenzaA__AHL89345

SEQ ID NO: 177056 - RNA, 1410 nt, Artificial Sequence; identical to SEQ ID NO: 168226
  derived and/or modified sequence opt4 from neuraminidase__InfluenzaA__AHL89357

SEQ ID NO: 177057 - RNA, 1410 nt, Artificial Sequence; identical to SEQ ID NO: 168227
  derived and/or modified sequence opt4 from neuraminidase__InfluenzaA__AHL89369

SEQ ID NO: 177058 - RNA, 1410 nt, Artificial Sequence
  derived and/or modified sequence opt4 from neuraminidase__InfluenzaA__AHL89381
augaaccccaaccagaagaucaucaccaucggcagcgugagccugaccaucagcaccaucugcuucuucaugcagaucgccauccugaucaccaccgugacccugcacuucaagcaguacgaguacaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177059 - RNA, 1410 nt, Artificial Sequence; identical to SEQ ID NO: 177049
  derived and/or modified sequence opt4 from neuraminidase__InfluenzaA__AHL89405

SEQ ID NO: 177060 - RNA, 1410 nt, Artificial Sequence
  derived and/or modified sequence opt4 from neuraminidase__InfluenzaA__AHL89417
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucgacaucaagaacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177061 - RNA, 1410 nt, Artificial Sequence; identical to SEQ ID NO: 168227
  derived and/or modified sequence opt4 from neuraminidase__InfluenzaA__AHL89429

SEQ ID NO: 177062 - RNA, 1410 nt, Artificial Sequence; identical to SEQ ID NO: 167232
  derived and/or modified sequence opt4 from neuraminidase__InfluenzaA__AHL89441

SEQ ID NO: 177063 - RNA, 1410 nt, Artificial Sequence; identical to SEQ ID NO: 167232
  derived and/or modified sequence opt4 from neuraminidase__InfluenzaA__AHL89453

SEQ ID NO: 177064 - RNA, 1410 nt, Artificial Sequence
  derived and/or modified sequence opt4 from neuraminidase__InfluenzaA__AHL89465
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaucaccaucgagaaggagaagugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacagaugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177065 - RNA, 1410 nt, Artificial Sequence; identical to SEQ ID NO: 177039
  derived and/or modified sequence opt4 from neuraminidase__InfluenzaA__AHL89477

SEQ ID NO: 177066 - RNA, 1410 nt, Artificial Sequence
  derived and/or modified sequence opt4 from neuraminidase__InfluenzaA__AHL89489
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcagcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagaagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaacccccacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177067 - RNA, 1410 nt, Artificial Sequence; identical to SEQ ID NO: 168227
  derived and/or modified sequence opt4 from neuraminidase__InfluenzaA__AHL89501

SEQ ID NO: 177068 - RNA, 1410 nt, Artificial Sequence; identical to SEQ ID NO: 168227
  derived and/or modified sequence opt4 from neuraminidase__InfluenzaA__AHL89513

SEQ ID NO: 177069 - RNA, 1410 nt, Artificial Sequence; identical to SEQ ID NO: 168227
  derived and/or modified sequence opt4 from neuraminidase__InfluenzaA__AHL89525

SEQ ID NO: 177070 - RNA, 1410 nt, Artificial Sequence; identical to SEQ ID NO: 168227
  derived and/or modified sequence opt4 from neuraminidase__InfluenzaA__AHL89537

SEQ ID NO: 177071 - RNA, 1413 nt, Artificial Sequence
  derived and/or modified sequence opt4 from neuraminidase__InfluenzaA__AHL89549
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagcaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 177072 - RNA, 1413 nt, Artificial Sequence; identical to SEQ ID NO: 168550
  derived and/or modified sequence opt4 from neuraminidase__InfluenzaA__AHL89561

SEQ ID NO: 177073 - RNA, 1413 nt, Artificial Sequence; identical to SEQ ID NO: 168550
  derived and/or modified sequence opt4 from neuraminidase__InfluenzaA__AHL89573

SEQ ID NO: 177074 - RNA, 1413 nt, Artificial Sequence; identical to SEQ ID NO: 168585
  derived and/or modified sequence opt4 from neuraminidase__InfluenzaA__AHL89585

SEQ ID NO: 177075 - RNA, 1413 nt, Artificial Sequence
  derived and/or modified sequence opt4 from neuraminidase__InfluenzaA__AHL89597
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugagagacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 177076 - RNA, 1413 nt, Artificial Sequence; identical to SEQ ID NO: 168585
  derived and/or modified sequence opt4 from neuraminidase__InfluenzaA__AHL89609

SEQ ID NO: 177077 - RNA, 1413 nt, Artificial Sequence
  derived and/or modified sequence opt4 from neuraminidase__InfluenzaA__AHL89621
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacacagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 177078 - RNA, 1413 nt, Artificial Sequence; identical to SEQ ID NO: 168576
  derived and/or modified sequence opt4 from neuraminidase__InfluenzaA__AHL89633

SEQ ID NO: 177079 - RNA, 1413 nt, Artificial Sequence; identical to SEQ ID NO: 168585
  derived and/or modified sequence opt4 from neuraminidase__InfluenzaA__AHL89645

SEQ ID NO: 177080 - RNA, 1413 nt, Artificial Sequence; identical to SEQ ID NO: 168550
  derived and/or modified sequence opt4 from neuraminidase__InfluenzaA__AHL89657

SEQ ID NO: 177081 - RNA, 1413 nt, Artificial Sequence
  derived and/or modified sequence opt4 from neuraminidase__InfluenzaA__AHL89669
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacgagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 177082 - RNA, 1413 nt, Artificial Sequence
  derived and/or modified sequence opt4 from neuraminidase__InfluenzaA__AHL89681
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaagaucaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccguggacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacgccaccaucuggaccagcggcagcagcaucagcuucugcggcguggacagcgacaccgccaacuggagcuggcccgacggcgccgagcugcccuucaccaucgacaaguga

SEQ ID NO: 177083 - RNA, 1413 nt, Artificial Sequence
  derived and/or modified sequence opt4 from neuraminidase__InfluenzaA__AHL89693
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaagggcaucaucaccggcaccaucaagagcuggagaaagcagauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacgacgacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177084 - RNA, 1413 nt, Artificial Sequence
  derived and/or modified sequence opt4 from neuraminidase__InfluenzaA__AHL89705
augaaccccaaccagaagaucaucaccaucggcagcaucagcaucgccaucggcaucaucagccugaugcugcagaucggcaacaucaucagcaucugggccagccacagcauccagaacggcagccagaaccacaccggcaucugcaaccagagaaucaucaccuacgagaacagcaccugggugaaccacaccuacgugagcaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 177085 - RNA, 1413 nt, Artificial Sequence; identical to SEQ ID NO: 168550
  derived and/or modified sequence opt4 from neuraminidase__InfluenzaA__AHL89717

SEQ ID NO: 177086 - RNA, 1413 nt, Artificial Sequence; identical to SEQ ID NO: 168550
  derived and/or modified sequence opt4 from neuraminidase__InfluenzaA__AHL89729

SEQ ID NO: 177087 - RNA, 1413 nt, Artificial Sequence
  derived and/or modified sequence opt4 from neuraminidase__InfluenzaA__AHL89753
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugagcaucaacaacaccaacgugguggccggcaacgacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 177088 - RNA, 1413 nt, Artificial Sequence; identical to SEQ ID NO: 168550
  derived and/or modified sequence opt4 from neuraminidase__InfluenzaA__AHL89765

SEQ ID NO: 177089 - RNA, 1413 nt, Artificial Sequence; identical to SEQ ID NO: 168591
  derived and/or modified sequence opt4 from neuraminidase__InfluenzaA__AHL89777

SEQ ID NO: 177090 - RNA, 1413 nt, Artificial Sequence; identical to SEQ ID NO: 168550
  derived and/or modified sequence opt4 from neuraminidase__InfluenzaA__AHL89789

SEQ ID NO: 177091 - RNA, 1413 nt, Artificial Sequence
  derived and/or modified sequence opt4 from neuraminidase__InfluenzaA__AHL89801
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcguggcccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 177092 - RNA, 1413 nt, Artificial Sequence
  derived and/or modified sequence opt4 from neuraminidase__InfluenzaA__AHL89813
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccaggugggcuacaucugcagcggcguguucggcgacaaccccagacccaaggacggcaagggcagcugcaaccccaugaccgccgacggcgccgacggcgugaagggcuucagcuacaaguacggcaacggcguguggaucggcagaaccaagagcaacaagcugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacgccaccaucuggaccagcggcagcagcaucagcuucugcggcguggacagcgacaccgccaacuggagcuggcccgacggcgccgagcugcccuucaccaucgacaaguga

SEQ ID NO: 177093 - RNA, 1413 nt, Artificial Sequence; identical to SEQ ID NO: 168591
  derived and/or modified sequence opt4 from neuraminidase__InfluenzaA__AHL89825

SEQ ID NO: 177094 - RNA, 1413 nt, Artificial Sequence; identical to SEQ ID NO: 168550
  derived and/or modified sequence opt4 from neuraminidase__InfluenzaA__AHL89837

SEQ ID NO: 177095 - RNA, 1413 nt, Artificial Sequence
  derived and/or modified sequence opt4 from neuraminidase__InfluenzaA__AHL89849
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacguguacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcauggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 177096 - RNA, 1410 nt, Artificial Sequence; identical to SEQ ID NO: 168586
  derived and/or modified sequence opt4 from neuraminidase__InfluenzaA__AHL89861

SEQ ID NO: 177097 - RNA, 1410 nt, Artificial Sequence
  derived and/or modified sequence opt4 from neuraminidase__InfluenzaA__AHL89873
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacggcggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177098 - RNA, 1410 nt, Artificial Sequence; identical to SEQ ID NO: 169263
  derived and/or modified sequence opt4 from neuraminidase__InfluenzaA__AHL89885

SEQ ID NO: 177099 - RNA, 1410 nt, Artificial Sequence
  derived and/or modified sequence opt4 from neuraminidase__InfluenzaA__AHL89897
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177100 - RNA, 1410 nt, Artificial Sequence; identical to SEQ ID NO: 168922
  derived and/or modified sequence opt4 from neuraminidase__InfluenzaA__AHL89909

SEQ ID NO: 177101 - RNA, 1410 nt, Artificial Sequence; identical to SEQ ID NO: 168561
  derived and/or modified sequence opt4 from neuraminidase__InfluenzaA__AHL89921

SEQ ID NO: 177102 - RNA, 1410 nt, Artificial Sequence; identical to SEQ ID NO: 168922
  derived and/or modified sequence opt4 from neuraminidase__InfluenzaA__AHL89933

SEQ ID NO: 177103 - RNA, 1410 nt, Artificial Sequence; identical to SEQ ID NO: 168561
  derived and/or modified sequence opt4 from neuraminidase__InfluenzaA__AHL89945

SEQ ID NO: 177104 - RNA, 1410 nt, Artificial Sequence
  derived and/or modified sequence opt4 from neuraminidase__InfluenzaA__AHL89957
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177105 - RNA, 1410 nt, Artificial Sequence; identical to SEQ ID NO: 168404
  derived and/or modified sequence opt4 from neuraminidase__InfluenzaA__AHL89969

SEQ ID NO: 177106 - RNA, 1410 nt, Artificial Sequence; identical to SEQ ID NO: 168404
  derived and/or modified sequence opt4 from neuraminidase__InfluenzaA__AHL89981

SEQ ID NO: 177107 - RNA, 1410 nt, Artificial Sequence
  derived and/or modified sequence opt4 from neuraminidase__InfluenzaA__AHL89993
augaaccccaaccagaagaucaucaccaucggcagcgugagccugagcaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcacccuggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177108 - RNA, 1410 nt, Artificial Sequence
  derived and/or modified sequence opt4 from neuraminidase__InfluenzaA__AHL90005
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucaagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcuacagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177109 - RNA, 1410 nt, Artificial Sequence; identical to SEQ ID NO: 168610
  derived and/or modified sequence opt4 from neuraminidase__InfluenzaA__AHL90017

SEQ ID NO: 177110 - RNA, 1410 nt, Artificial Sequence; identical to SEQ ID NO: 168561
  derived and/or modified sequence opt4 from neuraminidase__InfluenzaA__AHL90029

SEQ ID NO: 177111 - RNA, 1410 nt, Artificial Sequence; identical to SEQ ID NO: 168577
  derived and/or modified sequence opt4 from neuraminidase__InfluenzaA__AHL90041

SEQ ID NO: 177112 - RNA, 1410 nt, Artificial Sequence; identical to SEQ ID NO: 168577
  derived and/or modified sequence opt4 from neuraminidase__InfluenzaA__AHL90053

SEQ ID NO: 177113 - RNA, 1410 nt, Artificial Sequence; identical to SEQ ID NO: 174842
  derived and/or modified sequence opt4 from neuraminidase__InfluenzaA__AHL90065

SEQ ID NO: 177114 - RNA, 1410 nt, Artificial Sequence; identical to SEQ ID NO: 177104
  derived and/or modified sequence opt4 from neuraminidase__InfluenzaA__AHL90077

SEQ ID NO: 177115 - RNA, 1410 nt, Artificial Sequence; identical to SEQ ID NO: 168586
  derived and/or modified sequence opt4 from neuraminidase__InfluenzaA__AHL90089

SEQ ID NO: 177116 - RNA, 1410 nt, Artificial Sequence; identical to SEQ ID NO: 169263
  derived and/or modified sequence opt4 from neuraminidase__InfluenzaA__AHL90101

SEQ ID NO: 177117 - RNA, 1410 nt, Artificial Sequence; identical to SEQ ID NO: 168561
  derived and/or modified sequence opt4 from neuraminidase__InfluenzaA__AHL90113

SEQ ID NO: 177118 - RNA, 1413 nt, Artificial Sequence; identical to SEQ ID NO: 169152
  derived and/or modified sequence opt4 from neuraminidase__InfluenzaA__AHL90125

SEQ ID NO: 177119 - RNA, 1413 nt, Artificial Sequence
  derived and/or modified sequence opt4 from neuraminidase__InfluenzaA__AHL90136
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacagcggcauggugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177120 - RNA, 1413 nt, Artificial Sequence; identical to SEQ ID NO: 169152
  derived and/or modified sequence opt4 from neuraminidase__InfluenzaA__AHL90160

SEQ ID NO: 177121 - RNA, 1413 nt, Artificial Sequence
  derived and/or modified sequence opt4 from neuraminidase__InfluenzaA__AHL90172
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcaacugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177122 - RNA, 1413 nt, Artificial Sequence; identical to SEQ ID NO: 169152
  derived and/or modified sequence opt4 from neuraminidase__InfluenzaA__AHL90184

SEQ ID NO: 177123 - RNA, 1413 nt, Artificial Sequence; identical to SEQ ID NO: 172450
  derived and/or modified sequence opt4 from neuraminidase__InfluenzaA__AHL90196

SEQ ID NO: 177124 - RNA, 1413 nt, Artificial Sequence; identical to SEQ ID NO: 169152
  derived and/or modified sequence opt4 from neuraminidase__InfluenzaA__AHL90220

SEQ ID NO: 177125 - RNA, 1413 nt, Artificial Sequence
  derived and/or modified sequence opt4 from neuraminidase__InfluenzaA__AHL90232
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177126 - RNA, 1413 nt, Artificial Sequence
  derived and/or modified sequence opt4 from neuraminidase__InfluenzaA__AHL90244
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccaugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccagcuggagcuggcccgacggcgccgagcugcccuucaccaucgacaaguga

SEQ ID NO: 177127 - RNA, 1413 nt, Artificial Sequence; identical to SEQ ID NO: 169981
  derived and/or modified sequence opt4 from neuraminidase__InfluenzaA__AHL90256

SEQ ID NO: 177128 - RNA, 1413 nt, Artificial Sequence
  derived and/or modified sequence opt4 from neuraminidase__InfluenzaA__AHL90268
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccagcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagagacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177129 - RNA, 1413 nt, Artificial Sequence; identical to SEQ ID NO: 169981
  derived and/or modified sequence opt4 from neuraminidase__InfluenzaA__AHL90280

SEQ ID NO: 177130 - RNA, 1413 nt, Artificial Sequence
  derived and/or modified sequence opt4 from neuraminidase__InfluenzaA__AHL90304
augaaccccaaccagaagaucaucaccaucggcagcaucagcaucgccaucggcaucaucagccugaugcugcagaucggcaacaucaucagcaucugggccagccacagcauccagaccggcagccagaacaacaccgagaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177131 - RNA, 1413 nt, Artificial Sequence; identical to SEQ ID NO: 169152
  derived and/or modified sequence opt4 from neuraminidase__InfluenzaA__AHL90316

SEQ ID NO: 177132 - RNA, 1413 nt, Artificial Sequence
  derived and/or modified sequence opt4 from neuraminidase__InfluenzaA__AHL90328
augaaccccaacaagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccgugaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177133 - RNA, 1413 nt, Artificial Sequence; identical to SEQ ID NO: 169152
  derived and/or modified sequence opt4 from neuraminidase__InfluenzaA__AHL90340

SEQ ID NO: 177134 - RNA, 1413 nt, Artificial Sequence
  derived and/or modified sequence opt4 from neuraminidase__InfluenzaA__AHL90352
augaaccccaaccagaagaucaugaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcagccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcaugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177135 - RNA, 1413 nt, Artificial Sequence; identical to SEQ ID NO: 175981
  derived and/or modified sequence opt4 from neuraminidase__InfluenzaA__AHL90364

SEQ ID NO: 177136 - RNA, 1413 nt, Artificial Sequence; identical to SEQ ID NO: 169981
  derived and/or modified sequence opt4 from neuraminidase__InfluenzaA__AHL90376

SEQ ID NO: 177137 - RNA, 1410 nt, Artificial Sequence
  derived and/or modified sequence opt4 from neuraminidase__InfluenzaA__AHL90388
augaaccccaaccagaagaucaucaccaucggcagcgugagccugaucaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaucaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177138 - RNA, 1410 nt, Artificial Sequence; identical to SEQ ID NO: 169032
  derived and/or modified sequence opt4 from neuraminidase__InfluenzaA__AHL90400

SEQ ID NO: 177139 - RNA, 1410 nt, Artificial Sequence; identical to SEQ ID NO: 169032
  derived and/or modified sequence opt4 from neuraminidase__InfluenzaA__AHL90413

SEQ ID NO: 177140 - RNA, 1410 nt, Artificial Sequence
  derived and/or modified sequence opt4 from neuraminidase__InfluenzaA__AHL90425
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177141 - RNA, 1410 nt, Artificial Sequence; identical to SEQ ID NO: 169119
  derived and/or modified sequence opt4 from neuraminidase__InfluenzaA__AHL90437

SEQ ID NO: 177142 - RNA, 1410 nt, Artificial Sequence; identical to SEQ ID NO: 169032
  derived and/or modified sequence opt4 from neuraminidase__InfluenzaA__AHL90449

SEQ ID NO: 177143 - RNA, 1410 nt, Artificial Sequence; identical to SEQ ID NO: 169032
  derived and/or modified sequence opt4 from neuraminidase__InfluenzaA__AHL90461

SEQ ID NO: 177144 - RNA, 1410 nt, Artificial Sequence; identical to SEQ ID NO: 169032
  derived and/or modified sequence opt4 from neuraminidase__InfluenzaA__AHL90473

SEQ ID NO: 177145 - RNA, 1410 nt, Artificial Sequence; identical to SEQ ID NO: 169032
  derived and/or modified sequence opt4 from neuraminidase__InfluenzaA__AHL90485

SEQ ID NO: 177146 - RNA, 1410 nt, Artificial Sequence; identical to SEQ ID NO: 169123
  derived and/or modified sequence opt4 from neuraminidase__InfluenzaA__AHL90497

SEQ ID NO: 177147 - RNA, 1410 nt, Artificial Sequence; identical to SEQ ID NO: 169123
  derived and/or modified sequence opt4 from neuraminidase__InfluenzaA__AHL90509

SEQ ID NO: 177148 - RNA, 1410 nt, Artificial Sequence
  derived and/or modified sequence opt4 from neuraminidase__InfluenzaA__AHL90521
augaaccccaaccagaagaucaucaccaucggcagcgugagccugaccaucagcaccaucugcuucuuccugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177149 - RNA, 1410 nt, Artificial Sequence
  derived and/or modified sequence opt4 from neuraminidase__InfluenzaA__AHL90533
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggagagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177150 - RNA, 1410 nt, Artificial Sequence; identical to SEQ ID NO: 169032
  derived and/or modified sequence opt4 from neuraminidase__InfluenzaA__AHL90545

SEQ ID NO: 177151 - RNA, 1410 nt, Artificial Sequence; identical to SEQ ID NO: 169119
  derived and/or modified sequence opt4 from neuraminidase__InfluenzaA__AHL90557

SEQ ID NO: 177152 - RNA, 1410 nt, Artificial Sequence
  derived and/or modified sequence opt4 from neuraminidase__InfluenzaA__AHL90569
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaagggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177153 - RNA, 1410 nt, Artificial Sequence; identical to SEQ ID NO: 169119
  derived and/or modified sequence opt4 from neuraminidase__InfluenzaA__AHL90581

SEQ ID NO: 177154 - RNA, 1410 nt, Artificial Sequence; identical to SEQ ID NO: 169123
  derived and/or modified sequence opt4 from neuraminidase__InfluenzaA__AHL90593

SEQ ID NO: 177155 - RNA, 1410 nt, Artificial Sequence
  derived and/or modified sequence opt4 from neuraminidase__InfluenzaA__AHL90605
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 177156 - RNA, 1410 nt, Artificial Sequence; identical to SEQ ID NO: 169119
  derived and/or modified sequence opt4 from neuraminidase__InfluenzaA__AHL90629

SEQ ID NO: 177157 - RNA, 1410 nt, Artificial Sequence; identical to SEQ ID NO: 169119
  derived and/or modified sequence opt4 from neuraminidase__InfluenzaA__AHL90641

SEQ ID NO: 177158 - RNA, 1410 nt, Artificial Sequence; identical to SEQ ID NO: 169032
  derived and/or modified sequence opt4 from neuraminidase__InfluenzaA__AHL90653

SEQ ID NO: 177159 - RNA, 1410 nt, Artificial Sequence; identical to SEQ ID NO: 169119
  derived and/or modified sequence opt4 from neuraminidase__InfluenzaA__AHL90665

SEQ ID NO: 177160 - RNA, 1410 nt, Artificial Sequence
  derived and/or modified sequence opt4 from neuraminidase__InfluenzaA__AHL90677
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177161 - RNA, 1410 nt, Artificial Sequence; identical to SEQ ID NO: 169119
  derived and/or modified sequence opt4 from neuraminidase__InfluenzaA__AHL90689

SEQ ID NO: 177162 - RNA, 1410 nt, Artificial Sequence
  derived and/or modified sequence opt4 from neuraminidase__InfluenzaA__AHL90701
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcggcaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177163 - RNA, 1410 nt, Artificial Sequence; identical to SEQ ID NO: 171824
  derived and/or modified sequence opt4 from neuraminidase__InfluenzaA__AHL90713

SEQ ID NO: 177164 - RNA, 1413 nt, Artificial Sequence; identical to SEQ ID NO: 172457
  derived and/or modified sequence opt4 from neuraminidase__InfluenzaA__AHL90725

SEQ ID NO: 177165 - RNA, 1413 nt, Artificial Sequence; identical to SEQ ID NO: 171450
  derived and/or modified sequence opt4 from neuraminidase__InfluenzaA__AHL90749

SEQ ID NO: 177166 - RNA, 1413 nt, Artificial Sequence; identical to SEQ ID NO: 169981
  derived and/or modified sequence opt4 from neuraminidase__InfluenzaA__AHL90761

SEQ ID NO: 177167 - RNA, 1413 nt, Artificial Sequence
  derived and/or modified sequence opt4 from neuraminidase__InfluenzaA__AHL90773
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacagagagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177168 - RNA, 1413 nt, Artificial Sequence
  derived and/or modified sequence opt4 from neuraminidase__InfluenzaA__AHL90785
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccgugaacggcgccgacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaucaccaucuggaccagcggcagcagcaucagcuucugcggcgugaacagcgacaccgccaacuggagcuggcccgacggcgccgagcugcccuucaccaucgacaaguga

SEQ ID NO: 177169 - RNA, 1413 nt, Artificial Sequence
  derived and/or modified sequence opt4 from neuraminidase__InfluenzaA__AHL90797
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaacaagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucgccugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcgacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcagccccgugaccguggacggcgccaacggcgugaagggcuucagcuacaaguacgacaacggcguguggaucggcagaaccaagagcaacagacugagaaagggcuucgaggugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177170 - RNA, 1413 nt, Artificial Sequence; identical to SEQ ID NO: 169981
  derived and/or modified sequence opt4 from neuraminidase__InfluenzaA__AHL90809

SEQ ID NO: 177171 - RNA, 1413 nt, Artificial Sequence; identical to SEQ ID NO: 172457
  derived and/or modified sequence opt4 from neuraminidase__InfluenzaA__AHL90821

SEQ ID NO: 177172 - RNA, 1413 nt, Artificial Sequence
  derived and/or modified sequence opt4 from neuraminidase__InfluenzaA__AHL90833
augaaccccaaccagagaaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaugggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177173 - RNA, 1413 nt, Artificial Sequence; identical to SEQ ID NO: 169981
  derived and/or modified sequence opt4 from neuraminidase__InfluenzaA__AHL90845

SEQ ID NO: 177174 - RNA, 1413 nt, Artificial Sequence; identical to SEQ ID NO: 171450
  derived and/or modified sequence opt4 from neuraminidase__InfluenzaA__AHL90857

SEQ ID NO: 177175 - RNA, 1413 nt, Artificial Sequence; identical to SEQ ID NO: 169981
  derived and/or modified sequence opt4 from neuraminidase__InfluenzaA__AHL90869

SEQ ID NO: 177176 - RNA, 1413 nt, Artificial Sequence
  derived and/or modified sequence opt4 from neuraminidase__InfluenzaA__AHL90881
augaaccccaaccagaagaucaucaccaucggcagcaucagcaucgccaucggcaucaucagcaccaugcugcagaucggcagcaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugaucaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177177 - RNA, 1413 nt, Artificial Sequence; identical to SEQ ID NO: 172457
  derived and/or modified sequence opt4 from neuraminidase__InfluenzaA__AHL90893

SEQ ID NO: 177178 - RNA, 1413 nt, Artificial Sequence; identical to SEQ ID NO: 171450
  derived and/or modified sequence opt4 from neuraminidase__InfluenzaA__AHL90905

SEQ ID NO: 177179 - RNA, 1413 nt, Artificial Sequence
  derived and/or modified sequence opt4 from neuraminidase__InfluenzaA__AHL90917
augaaccccaaccagaagaucaucaccaucggcagcaucagcaucgccaucggcaucaucagccugacccugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177180 - RNA, 1413 nt, Artificial Sequence
  derived and/or modified sequence opt4 from neuraminidase__InfluenzaA__AHL90929
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177181 - RNA, 1413 nt, Artificial Sequence; identical to SEQ ID NO: 171450
  derived and/or modified sequence opt4 from neuraminidase__InfluenzaA__AHL90941

SEQ ID NO: 177182 - RNA, 1413 nt, Artificial Sequence; identical to SEQ ID NO: 171450
  derived and/or modified sequence opt4 from neuraminidase__InfluenzaA__AHL90953

SEQ ID NO: 177183 - RNA, 1413 nt, Artificial Sequence; identical to SEQ ID NO: 171450
  derived and/or modified sequence opt4 from neuraminidase__InfluenzaA__AHL90965

SEQ ID NO: 177184 - RNA, 1413 nt, Artificial Sequence
  derived and/or modified sequence opt4 from neuraminidase__InfluenzaA__AHL90977
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucgccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177185 - RNA, 1413 nt, Artificial Sequence; identical to SEQ ID NO: 172724
  derived and/or modified sequence opt4 from neuraminidase__InfluenzaA__AHL90989

SEQ ID NO: 177186 - RNA, 1413 nt, Artificial Sequence; identical to SEQ ID NO: 177180
  derived and/or modified sequence opt4 from neuraminidase__InfluenzaA__AHL91001

SEQ ID NO: 177187 - RNA, 1413 nt, Artificial Sequence
  derived and/or modified sequence opt4 from neuraminidase__InfluenzaA__AHL91013
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcagccagagaaucaucaccuacgagaacagcaccugggugaaccacaccuacgugaacaucaacaacaccaacgugguggccggcgaggacaagaccagcaugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucagaagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 177188 - RNA, 1413 nt, Artificial Sequence; identical to SEQ ID NO: 177180
  derived and/or modified sequence opt4 from neuraminidase__InfluenzaA__AHL91025

SEQ ID NO: 177189 - RNA, 1410 nt, Artificial Sequence; identical to SEQ ID NO: 170425
  derived and/or modified sequence opt4 from neuraminidase__InfluenzaA__AHL91037

SEQ ID NO: 177190 - RNA, 1410 nt, Artificial Sequence; identical to SEQ ID NO: 172038
  derived and/or modified sequence opt4 from neuraminidase__InfluenzaA__AHL91049

SEQ ID NO: 177191 - RNA, 1410 nt, Artificial Sequence
  derived and/or modified sequence opt4 from neuraminidase__InfluenzaA__AHL91061
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177192 - RNA, 1410 nt, Artificial Sequence
  derived and/or modified sequence opt4 from neuraminidase__InfluenzaA__AHL91073
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaccuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcggcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177193 - RNA, 1410 nt, Artificial Sequence
  derived and/or modified sequence opt4 from neuraminidase__InfluenzaA__AHL91085
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaagaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaucugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 177194 - RNA, 1410 nt, Artificial Sequence; identical to SEQ ID NO: 169119
  derived and/or modified sequence opt4 from neuraminidase__InfluenzaA__AHL91097

SEQ ID NO: 177195 - RNA, 1410 nt, Artificial Sequence
  derived and/or modified sequence opt4 from neuraminidase__InfluenzaA__AHL91109
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaacaucaugcccaucuga

SEQ ID NO: 177196 - RNA, 1410 nt, Artificial Sequence; identical to SEQ ID NO: 170425
  derived and/or modified sequence opt4 from neuraminidase__InfluenzaA__AHL91121

SEQ ID NO: 177197 - RNA, 1410 nt, Artificial Sequence
  derived and/or modified sequence opt4 from neuraminidase__InfluenzaA__AHL91133
augaaccccaaccagaagaucaucaccaucggcagcgugagccugaccaucagcaccaucugcuucuucaugcagaucgccauccugaucaccaccgugacccugcacuucaagcaguucgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccacaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177198 - RNA, 1410 nt, Artificial Sequence; identical to SEQ ID NO: 171824
  derived and/or modified sequence opt4 from neuraminidase__InfluenzaA__AHL91145

SEQ ID NO: 177199 - RNA, 1410 nt, Artificial Sequence; identical to SEQ ID NO: 171824
  derived and/or modified sequence opt4 from neuraminidase__InfluenzaA__AHL91157

SEQ ID NO: 177200 - RNA, 1410 nt, Artificial Sequence; identical to SEQ ID NO: 167232
  derived and/or modified sequence opt4 from neuraminidase__InfluenzaA__AHL91169

SEQ ID NO: 177201 - RNA, 1410 nt, Artificial Sequence; identical to SEQ ID NO: 174666
  derived and/or modified sequence opt4 from neuraminidase__InfluenzaA__AHL94987

SEQ ID NO: 177202 - RNA, 1410 nt, Artificial Sequence; identical to SEQ ID NO: 174666
  derived and/or modified sequence opt4 from neuraminidase__InfluenzaA__AHL94999

SEQ ID NO: 177203 - RNA, 1410 nt, Artificial Sequence
  derived and/or modified sequence opt4 from neuraminidase__InfluenzaA__AHL95011
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcugguucaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177204 - RNA, 1410 nt, Artificial Sequence; identical to SEQ ID NO: 176423
  derived and/or modified sequence opt4 from neuraminidase__InfluenzaA__AHL95023

SEQ ID NO: 177205 - RNA, 1410 nt, Artificial Sequence; identical to SEQ ID NO: 174666
  derived and/or modified sequence opt4 from neuraminidase__InfluenzaA__AHL95035

SEQ ID NO: 177206 - RNA, 1410 nt, Artificial Sequence; identical to SEQ ID NO: 174666
  derived and/or modified sequence opt4 from neuraminidase__InfluenzaA__AHL95047

SEQ ID NO: 177207 - RNA, 1410 nt, Artificial Sequence; identical to SEQ ID NO: 176414
  derived and/or modified sequence opt4 from neuraminidase__InfluenzaA__AHL95059

SEQ ID NO: 177208 - RNA, 1410 nt, Artificial Sequence; identical to SEQ ID NO: 174666
  derived and/or modified sequence opt4 from neuraminidase__InfluenzaA__AHL95071

SEQ ID NO: 177209 - RNA, 1410 nt, Artificial Sequence; identical to SEQ ID NO: 174666
  derived and/or modified sequence opt4 from neuraminidase__InfluenzaA__AHL95083

SEQ ID NO: 177210 - RNA, 1410 nt, Artificial Sequence; identical to SEQ ID NO: 174666
  derived and/or modified sequence opt4 from neuraminidase__InfluenzaA__AHL95095

SEQ ID NO: 177211 - RNA, 1410 nt, Artificial Sequence; identical to SEQ ID NO: 174666
  derived and/or modified sequence opt4 from neuraminidase__InfluenzaA__AHL95107

SEQ ID NO: 177212 - RNA, 1410 nt, Artificial Sequence
  derived and/or modified sequence opt4 from neuraminidase__InfluenzaA__AHL95119
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagccugagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177213 - RNA, 1410 nt, Artificial Sequence; identical to SEQ ID NO: 175895
  derived and/or modified sequence opt4 from neuraminidase__InfluenzaA__AHL95131

SEQ ID NO: 177214 - RNA, 1410 nt, Artificial Sequence; identical to SEQ ID NO: 176403
  derived and/or modified sequence opt4 from neuraminidase__InfluenzaA__AHL95143

SEQ ID NO: 177215 - RNA, 1410 nt, Artificial Sequence
  derived and/or modified sequence opt4 from neuraminidase__InfluenzaA__AHL95155
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcagccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177216 - RNA, 1410 nt, Artificial Sequence
  derived and/or modified sequence opt4 from neuraminidase__InfluenzaA__AHL95167
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177217 - RNA, 1410 nt, Artificial Sequence; identical to SEQ ID NO: 174666
  derived and/or modified sequence opt4 from neuraminidase__InfluenzaA__AHL95179

SEQ ID NO: 177218 - RNA, 1410 nt, Artificial Sequence; identical to SEQ ID NO: 174666
  derived and/or modified sequence opt4 from neuraminidase__InfluenzaA__AHL95191

SEQ ID NO: 177219 - RNA, 1410 nt, Artificial Sequence; identical to SEQ ID NO: 174666
  derived and/or modified sequence opt4 from neuraminidase__InfluenzaA__AHL95203

SEQ ID NO: 177220 - RNA, 1410 nt, Artificial Sequence; identical to SEQ ID NO: 174666
  derived and/or modified sequence opt4 from neuraminidase__InfluenzaA__AHL95215

SEQ ID NO: 177221 - RNA, 1410 nt, Artificial Sequence
  derived and/or modified sequence opt4 from neuraminidase__InfluenzaA__AHL95227
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagagagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177222 - RNA, 1410 nt, Artificial Sequence; identical to SEQ ID NO: 176403
  derived and/or modified sequence opt4 from neuraminidase__InfluenzaA__AHL95239

SEQ ID NO: 177223 - RNA, 1410 nt, Artificial Sequence
  derived and/or modified sequence opt4 from neuraminidase__InfluenzaA__AHL95251
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177224 - RNA, 1410 nt, Artificial Sequence; identical to SEQ ID NO: 174666
  derived and/or modified sequence opt4 from neuraminidase__InfluenzaA__AHL95263

SEQ ID NO: 177225 - RNA, 1410 nt, Artificial Sequence
  derived and/or modified sequence opt4 from neuraminidase__InfluenzaA__AHL95275
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaucaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177226 - RNA, 1410 nt, Artificial Sequence; identical to SEQ ID NO: 175909
  derived and/or modified sequence opt4 from neuraminidase__InfluenzaA__AHL95299

SEQ ID NO: 177227 - RNA, 1410 nt, Artificial Sequence
  derived and/or modified sequence opt4 from neuraminidase__InfluenzaA__AHL95310
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaaccugaaccugaugcccaucuga

SEQ ID NO: 177228 - RNA, 1410 nt, Artificial Sequence; identical to SEQ ID NO: 176414
  derived and/or modified sequence opt4 from neuraminidase__InfluenzaA__AHL95322

SEQ ID NO: 177229 - RNA, 1410 nt, Artificial Sequence; identical to SEQ ID NO: 176391
  derived and/or modified sequence opt4 from neuraminidase__InfluenzaA__AHL95334

SEQ ID NO: 177230 - RNA, 1410 nt, Artificial Sequence; identical to SEQ ID NO: 174666
  derived and/or modified sequence opt4 from neuraminidase__InfluenzaA__AHL95423

SEQ ID NO: 177231 - RNA, 1410 nt, Artificial Sequence; identical to SEQ ID NO: 176414
  derived and/or modified sequence opt4 from neuraminidase__InfluenzaA__AHL95435

SEQ ID NO: 177232 - RNA, 1410 nt, Artificial Sequence; identical to SEQ ID NO: 176391
  derived and/or modified sequence opt4 from neuraminidase__InfluenzaA__AHL95447

SEQ ID NO: 177233 - RNA, 1410 nt, Artificial Sequence
  derived and/or modified sequence opt4 from neuraminidase__InfluenzaA__AHL95461
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177234 - RNA, 1410 nt, Artificial Sequence; identical to SEQ ID NO: 175442
  derived and/or modified sequence opt4 from neuraminidase__InfluenzaA__AHL95473

SEQ ID NO: 177235 - RNA, 1410 nt, Artificial Sequence; identical to SEQ ID NO: 174666
  derived and/or modified sequence opt4 from neuraminidase__InfluenzaA__AHL95485

SEQ ID NO: 177236 - RNA, 1410 nt, Artificial Sequence; identical to SEQ ID NO: 174666
  derived and/or modified sequence opt4 from neuraminidase__InfluenzaA__AHL95497

SEQ ID NO: 177237 - RNA, 1410 nt, Artificial Sequence
  derived and/or modified sequence opt4 from neuraminidase__InfluenzaA__AHL95509
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaagaaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177238 - RNA, 1410 nt, Artificial Sequence; identical to SEQ ID NO: 174666
  derived and/or modified sequence opt4 from neuraminidase__InfluenzaA__AHL95521

SEQ ID NO: 177239 - RNA, 1410 nt, Artificial Sequence; identical to SEQ ID NO: 174666
  derived and/or modified sequence opt4 from neuraminidase__InfluenzaA__AHL95533

SEQ ID NO: 177240 - RNA, 1410 nt, Artificial Sequence; identical to SEQ ID NO: 174666
  derived and/or modified sequence opt4 from neuraminidase__InfluenzaA__AHL95545

SEQ ID NO: 177241 - RNA, 1410 nt, Artificial Sequence
  derived and/or modified sequence opt4 from neuraminidase__InfluenzaA__AHL95557
augaaccccaaccagaagaucaucaccaucggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccgagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177242 - RNA, 1410 nt, Artificial Sequence; identical to SEQ ID NO: 176391
  derived and/or modified sequence opt4 from neuraminidase__InfluenzaA__AHL95569

SEQ ID NO: 177243 - RNA, 1410 nt, Artificial Sequence; identical to SEQ ID NO: 174666
  derived and/or modified sequence opt4 from neuraminidase__InfluenzaA__AHL95581

SEQ ID NO: 177244 - RNA, 1410 nt, Artificial Sequence
  derived and/or modified sequence opt4 from neuraminidase__InfluenzaA__AHL95605
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacaucagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177245 - RNA, 1410 nt, Artificial Sequence; identical to SEQ ID NO: 174666
  derived and/or modified sequence opt4 from neuraminidase__InfluenzaA__AHL95617

SEQ ID NO: 177246 - RNA, 1410 nt, Artificial Sequence; identical to SEQ ID NO: 174666
  derived and/or modified sequence opt4 from neuraminidase__InfluenzaA__AHL95629

SEQ ID NO: 177247 - RNA, 1410 nt, Artificial Sequence; identical to SEQ ID NO: 174666
  derived and/or modified sequence opt4 from neuraminidase__InfluenzaA__AHL95641

SEQ ID NO: 177248 - RNA, 1410 nt, Artificial Sequence; identical to SEQ ID NO: 174666
  derived and/or modified sequence opt4 from neuraminidase__InfluenzaA__AHL95653

SEQ ID NO: 177249 - RNA, 1410 nt, Artificial Sequence; identical to SEQ ID NO: 177244
  derived and/or modified sequence opt4 from neuraminidase__InfluenzaA__AHL95665

SEQ ID NO: 177250 - RNA, 1410 nt, Artificial Sequence; identical to SEQ ID NO: 174666
  derived and/or modified sequence opt4 from neuraminidase__InfluenzaA__AHL95677

SEQ ID NO: 177251 - RNA, 1410 nt, Artificial Sequence
  derived and/or modified sequence opt4 from neuraminidase__InfluenzaA__AHL95689
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaaccugaaccugaugcccaucuga

SEQ ID NO: 177252 - RNA, 1410 nt, Artificial Sequence; identical to SEQ ID NO: 174666
  derived and/or modified sequence opt4 from neuraminidase__InfluenzaA__AHL95701

SEQ ID NO: 177253 - RNA, 1410 nt, Artificial Sequence; identical to SEQ ID NO: 174666
  derived and/or modified sequence opt4 from neuraminidase__InfluenzaA__AHL95713

SEQ ID NO: 177254 - RNA, 1410 nt, Artificial Sequence
  derived and/or modified sequence opt4 from neuraminidase__InfluenzaA__AHL95725
augaaccccaaccagaagaucaucaccaucggcagcgugagccugaccaucagcaccaucugcuucuucaugcagaucgccauccugaucaccaccgugacccugcacuucaagcaguacgaguucgaccccccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaucgaggugcuguggaccagcaacagcaucgugguguucugcggcaccagcggcaccuacggcaccggcagcuggcccgacggcgccgaccugaaccugaugcccaucuga

SEQ ID NO: 177255 - RNA, 1410 nt, Artificial Sequence; identical to SEQ ID NO: 176403
  derived and/or modified sequence opt4 from neuraminidase__InfluenzaA__AHL95737

SEQ ID NO: 177256 - RNA, 1410 nt, Artificial Sequence
  derived and/or modified sequence opt4 from neuraminidase__InfluenzaA__AHL95749
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177257 - RNA, 1410 nt, Artificial Sequence; identical to SEQ ID NO: 174666
  derived and/or modified sequence opt4 from neuraminidase__InfluenzaA__AHL95761

SEQ ID NO: 177258 - RNA, 1410 nt, Artificial Sequence; identical to SEQ ID NO: 174666
  derived and/or modified sequence opt4 from neuraminidase__InfluenzaA__AHL95773

SEQ ID NO: 177259 - RNA, 1410 nt, Artificial Sequence
  derived and/or modified sequence opt4 from neuraminidase__InfluenzaA__AHL95785
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcgugagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177260 - RNA, 1410 nt, Artificial Sequence; identical to SEQ ID NO: 176391
  derived and/or modified sequence opt4 from neuraminidase__InfluenzaA__AHL95797

SEQ ID NO: 177261 - RNA, 1410 nt, Artificial Sequence; identical to SEQ ID NO: 174666
  derived and/or modified sequence opt4 from neuraminidase__InfluenzaA__AHL95833

SEQ ID NO: 177262 - RNA, 1410 nt, Artificial Sequence; identical to SEQ ID NO: 176391
  derived and/or modified sequence opt4 from neuraminidase__InfluenzaA__AHL95845

SEQ ID NO: 177263 - RNA, 1410 nt, Artificial Sequence
  derived and/or modified sequence opt4 from neuraminidase__InfluenzaA__AHL95857
augaaccccaaccagaagaucaucagcaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177264 - RNA, 1410 nt, Artificial Sequence; identical to SEQ ID NO: 174666
  derived and/or modified sequence opt4 from neuraminidase__InfluenzaA__AHL95869

SEQ ID NO: 177265 - RNA, 1410 nt, Artificial Sequence
  derived and/or modified sequence opt4 from neuraminidase__InfluenzaA__AHL95881
augaaccccaaccagaagaucaucaccaucggcagcgugugcaugaccaucggcauggccaaccugauccugcagaucggcaacaucaucagcaucuggaucagccacagcauccaggugggcaaccagagccagaucgagaccugcaaccagagcgugaucaccuacgagaacaacaccugggugaaccagaccuacgugaacaucagcaacaccaaccuggccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177266 - RNA, 1410 nt, Artificial Sequence
  derived and/or modified sequence opt4 from neuraminidase__InfluenzaA__AHL95892
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177267 - RNA, 1410 nt, Artificial Sequence; identical to SEQ ID NO: 174666
  derived and/or modified sequence opt4 from neuraminidase__InfluenzaA__AHL95904

SEQ ID NO: 177268 - RNA, 1410 nt, Artificial Sequence
  derived and/or modified sequence opt4 from neuraminidase__InfluenzaA__AHL95916
augaaccccaaccagaagaucaucaccaucggcagcgugagccugaccaucagcaccaucugcuucuucaugcagaucgccauccugaucaccaccgugacccugcacuucaagcaguacgagcugaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177269 - RNA, 1410 nt, Artificial Sequence; identical to SEQ ID NO: 176403
  derived and/or modified sequence opt4 from neuraminidase__InfluenzaA__AHL95928

SEQ ID NO: 177270 - RNA, 1410 nt, Artificial Sequence; identical to SEQ ID NO: 176391
  derived and/or modified sequence opt4 from neuraminidase__InfluenzaA__AHL95940

SEQ ID NO: 177271 - RNA, 1410 nt, Artificial Sequence; identical to SEQ ID NO: 174666
  derived and/or modified sequence opt4 from neuraminidase__InfluenzaA__AHL95952

SEQ ID NO: 177272 - RNA, 1410 nt, Artificial Sequence; identical to SEQ ID NO: 174666
  derived and/or modified sequence opt4 from neuraminidase__InfluenzaA__AHL95964

SEQ ID NO: 177273 - RNA, 1410 nt, Artificial Sequence; identical to SEQ ID NO: 174666
  derived and/or modified sequence opt4 from neuraminidase__InfluenzaA__AHL95976

SEQ ID NO: 177274 - RNA, 1410 nt, Artificial Sequence; identical to SEQ ID NO: 174666
  derived and/or modified sequence opt4 from neuraminidase__InfluenzaA__AHL95988

SEQ ID NO: 177275 - RNA, 1410 nt, Artificial Sequence; identical to SEQ ID NO: 174666
  derived and/or modified sequence opt4 from neuraminidase__InfluenzaA__AHL96000

SEQ ID NO: 177276 - RNA, 1410 nt, Artificial Sequence
  derived and/or modified sequence opt4 from neuraminidase__InfluenzaA__AHL96012
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagugcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177277 - RNA, 1410 nt, Artificial Sequence
  derived and/or modified sequence opt4 from neuraminidase__InfluenzaA__AHL96024
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagaaccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177278 - RNA, 1410 nt, Artificial Sequence; identical to SEQ ID NO: 174666
  derived and/or modified sequence opt4 from neuraminidase__InfluenzaA__AHL96036

SEQ ID NO: 177279 - RNA, 1410 nt, Artificial Sequence; identical to SEQ ID NO: 175909
  derived and/or modified sequence opt4 from neuraminidase__InfluenzaA__AHL96048

SEQ ID NO: 177280 - RNA, 1410 nt, Artificial Sequence; identical to SEQ ID NO: 174666
  derived and/or modified sequence opt4 from neuraminidase__InfluenzaA__AHL96059

SEQ ID NO: 177281 - RNA, 1410 nt, Artificial Sequence; identical to SEQ ID NO: 176403
  derived and/or modified sequence opt4 from neuraminidase__InfluenzaA__AHL96071

SEQ ID NO: 177282 - RNA, 1410 nt, Artificial Sequence; identical to SEQ ID NO: 177244
  derived and/or modified sequence opt4 from neuraminidase__InfluenzaA__AHL96083

SEQ ID NO: 177283 - RNA, 1410 nt, Artificial Sequence; identical to SEQ ID NO: 174666
  derived and/or modified sequence opt4 from neuraminidase__InfluenzaA__AHL96095

SEQ ID NO: 177284 - RNA, 1410 nt, Artificial Sequence
  derived and/or modified sequence opt4 from neuraminidase__InfluenzaA__AHL96107
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacaacagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177285 - RNA, 1410 nt, Artificial Sequence; identical to SEQ ID NO: 174666
  derived and/or modified sequence opt4 from neuraminidase__InfluenzaA__AHL96119

SEQ ID NO: 177286 - RNA, 1410 nt, Artificial Sequence; identical to SEQ ID NO: 176403
  derived and/or modified sequence opt4 from neuraminidase__InfluenzaA__AHL96131

SEQ ID NO: 177287 - RNA, 1410 nt, Artificial Sequence; identical to SEQ ID NO: 174666
  derived and/or modified sequence opt4 from neuraminidase__InfluenzaA__AHL96143

SEQ ID NO: 177288 - RNA, 1410 nt, Artificial Sequence; identical to SEQ ID NO: 174666
  derived and/or modified sequence opt4 from neuraminidase__InfluenzaA__AHL96167

SEQ ID NO: 177289 - RNA, 1410 nt, Artificial Sequence; identical to SEQ ID NO: 174666
  derived and/or modified sequence opt4 from neuraminidase__InfluenzaA__AHL96179

SEQ ID NO: 177290 - RNA, 1410 nt, Artificial Sequence
  derived and/or modified sequence opt4 from neuraminidase__InfluenzaA__AHL96191
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177291 - RNA, 1410 nt, Artificial Sequence; identical to SEQ ID NO: 176391
  derived and/or modified sequence opt4 from neuraminidase__InfluenzaA__AHL96203

SEQ ID NO: 177292 - RNA, 1410 nt, Artificial Sequence; identical to SEQ ID NO: 176403
  derived and/or modified sequence opt4 from neuraminidase__InfluenzaA__AHL96215

SEQ ID NO: 177293 - RNA, 1410 nt, Artificial Sequence; identical to SEQ ID NO: 174666
  derived and/or modified sequence opt4 from neuraminidase__InfluenzaA__AHL96227

SEQ ID NO: 177294 - RNA, 1410 nt, Artificial Sequence; identical to SEQ ID NO: 174666
  derived and/or modified sequence opt4 from neuraminidase__InfluenzaA__AHL96239

SEQ ID NO: 177295 - RNA, 1410 nt, Artificial Sequence; identical to SEQ ID NO: 174666
  derived and/or modified sequence opt4 from neuraminidase__InfluenzaA__AHL96251

SEQ ID NO: 177296 - RNA, 1410 nt, Artificial Sequence; identical to SEQ ID NO: 174666
  derived and/or modified sequence opt4 from neuraminidase__InfluenzaA__AHL96263

SEQ ID NO: 177297 - RNA, 1410 nt, Artificial Sequence; identical to SEQ ID NO: 176447
  derived and/or modified sequence opt4 from neuraminidase__InfluenzaA__AHL96277

SEQ ID NO: 177298 - RNA, 1410 nt, Artificial Sequence
  derived and/or modified sequence opt4 from neuraminidase__InfluenzaA__AHL96308
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugagcgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177299 - RNA, 1410 nt, Artificial Sequence; identical to SEQ ID NO: 175895
  derived and/or modified sequence opt4 from neuraminidase__InfluenzaA__AHL96321

SEQ ID NO: 177300 - RNA, 1410 nt, Artificial Sequence; identical to SEQ ID NO: 174666
  derived and/or modified sequence opt4 from neuraminidase__InfluenzaA__AHL96333

SEQ ID NO: 177301 - RNA, 1410 nt, Artificial Sequence
  derived and/or modified sequence opt4 from neuraminidase__InfluenzaA__AHL96345
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacaacagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177302 - RNA, 1410 nt, Artificial Sequence; identical to SEQ ID NO: 176391
  derived and/or modified sequence opt4 from neuraminidase__InfluenzaA__AHL96357

SEQ ID NO: 177303 - RNA, 1410 nt, Artificial Sequence; identical to SEQ ID NO: 174666
  derived and/or modified sequence opt4 from neuraminidase__InfluenzaA__AHL96369

SEQ ID NO: 177304 - RNA, 1410 nt, Artificial Sequence; identical to SEQ ID NO: 174666
  derived and/or modified sequence opt4 from neuraminidase__InfluenzaA__AHL96381

SEQ ID NO: 177305 - RNA, 1410 nt, Artificial Sequence; identical to SEQ ID NO: 176403
  derived and/or modified sequence opt4 from neuraminidase__InfluenzaA__AHL96393

SEQ ID NO: 177306 - RNA, 1410 nt, Artificial Sequence
  derived and/or modified sequence opt4 from neuraminidase__InfluenzaA__AHL96405
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugggccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177307 - RNA, 1410 nt, Artificial Sequence; identical to SEQ ID NO: 174666
  derived and/or modified sequence opt4 from neuraminidase__InfluenzaA__AHL96417

SEQ ID NO: 177308 - RNA, 1410 nt, Artificial Sequence; identical to SEQ ID NO: 174666
  derived and/or modified sequence opt4 from neuraminidase__InfluenzaA__AHL96429

SEQ ID NO: 177309 - RNA, 1410 nt, Artificial Sequence
  derived and/or modified sequence opt4 from neuraminidase__InfluenzaA__AHL96441
augaaccccaaccagaagaucaucaccaucggcagcgugagccugaccaucagcaccaucugcuucuucaugcagaucgccauccugaucaccaccgugacccugcacuucaagcacuacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacagaucaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177310 - RNA, 1410 nt, Artificial Sequence; identical to SEQ ID NO: 174666
  derived and/or modified sequence opt4 from neuraminidase__InfluenzaA__AHL96453

SEQ ID NO: 177311 - RNA, 1410 nt, Artificial Sequence; identical to SEQ ID NO: 174666
  derived and/or modified sequence opt4 from neuraminidase__InfluenzaA__AHL96465

SEQ ID NO: 177312 - RNA, 1410 nt, Artificial Sequence
  derived and/or modified sequence opt4 from neuraminidase__InfluenzaA__AHL96477
augaaccccaaccagaagaucaucaccaucggcagcgugugcaugaccaucggcauggccaaccugauccugcagaucggcaacaucaucagcaucuggaucagccacagcauccaggugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177313 - RNA, 1410 nt, Artificial Sequence; identical to SEQ ID NO: 176403
  derived and/or modified sequence opt4 from neuraminidase__InfluenzaA__AHL96488

SEQ ID NO: 177314 - RNA, 1410 nt, Artificial Sequence; identical to SEQ ID NO: 174666
  derived and/or modified sequence opt4 from neuraminidase__InfluenzaA__AHL96500

SEQ ID NO: 177315 - RNA, 1410 nt, Artificial Sequence; identical to SEQ ID NO: 174666
  derived and/or modified sequence opt4 from neuraminidase__InfluenzaA__AHL96512

SEQ ID NO: 177316 - RNA, 1410 nt, Artificial Sequence; identical to SEQ ID NO: 175895
  derived and/or modified sequence opt4 from neuraminidase__InfluenzaA__AHL96524

SEQ ID NO: 177317 - RNA, 1410 nt, Artificial Sequence
  derived and/or modified sequence opt4 from neuraminidase__InfluenzaA__AHL96536
augaaccccaaccagaagaucaucaccaucggcagcgugagccugaccaucagcaccaucugcuucuucacccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccaccaucaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177318 - RNA, 1410 nt, Artificial Sequence; identical to SEQ ID NO: 176403
  derived and/or modified sequence opt4 from neuraminidase__InfluenzaA__AHL96548

SEQ ID NO: 177319 - RNA, 1410 nt, Artificial Sequence
  derived and/or modified sequence opt4 from neuraminidase__InfluenzaA__AHL96560
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcaacgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177320 - RNA, 1410 nt, Artificial Sequence; identical to SEQ ID NO: 175877
  derived and/or modified sequence opt4 from neuraminidase__InfluenzaA__AHL96572

SEQ ID NO: 177321 - RNA, 1410 nt, Artificial Sequence; identical to SEQ ID NO: 177312
  derived and/or modified sequence opt4 from neuraminidase__InfluenzaA__AHL96584

SEQ ID NO: 177322 - RNA, 1410 nt, Artificial Sequence
  derived and/or modified sequence opt4 from neuraminidase__InfluenzaA__AHL96595
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagagcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177323 - RNA, 1410 nt, Artificial Sequence; identical to SEQ ID NO: 174666
  derived and/or modified sequence opt4 from neuraminidase__InfluenzaA__AHL96607

SEQ ID NO: 177324 - RNA, 1410 nt, Artificial Sequence
  derived and/or modified sequence opt4 from neuraminidase__InfluenzaA__AHL96631
augaaccccaaccagaagaucaucaccaucggcagcgugagccugaccaucagcaccaucugcuucuucaugcagaucgccauccugaucaccaccgugacccugcacuucaagcaguacgaguucaacagccugcccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177325 - RNA, 1410 nt, Artificial Sequence; identical to SEQ ID NO: 176403
  derived and/or modified sequence opt4 from neuraminidase__InfluenzaA__AHL96643

SEQ ID NO: 177326 - RNA, 1410 nt, Artificial Sequence; identical to SEQ ID NO: 174666
  derived and/or modified sequence opt4 from neuraminidase__InfluenzaA__AHL96655

SEQ ID NO: 177327 - RNA, 1410 nt, Artificial Sequence; identical to SEQ ID NO: 174666
  derived and/or modified sequence opt4 from neuraminidase__InfluenzaA__AHL96667

SEQ ID NO: 177328 - RNA, 1410 nt, Artificial Sequence; identical to SEQ ID NO: 174666
  derived and/or modified sequence opt4 from neuraminidase__InfluenzaA__AHL96679

SEQ ID NO: 177329 - RNA, 1410 nt, Artificial Sequence; identical to SEQ ID NO: 174666
  derived and/or modified sequence opt4 from neuraminidase__InfluenzaA__AHL96691

SEQ ID NO: 177330 - RNA, 1410 nt, Artificial Sequence; identical to SEQ ID NO: 174666
  derived and/or modified sequence opt4 from neuraminidase__InfluenzaA__AHL96703

SEQ ID NO: 177331 - RNA, 1410 nt, Artificial Sequence; identical to SEQ ID NO: 176391
  derived and/or modified sequence opt4 from neuraminidase__InfluenzaA__AHL96763

SEQ ID NO: 177332 - RNA, 1410 nt, Artificial Sequence; identical to SEQ ID NO: 177244
  derived and/or modified sequence opt4 from neuraminidase__InfluenzaA__AHL96787

SEQ ID NO: 177333 - RNA, 1410 nt, Artificial Sequence
  derived and/or modified sequence opt4 from neuraminidase__InfluenzaA__AHL96799
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggacgagaccgaggugcuguggaccagcaacagcaucgugguguucugcggcaccagcggcaccuacggcaccggcagcuggcccgacggcgccgaccugaaccugaugcccaucuga

SEQ ID NO: 177334 - RNA, 1410 nt, Artificial Sequence; identical to SEQ ID NO: 176403
  derived and/or modified sequence opt4 from neuraminidase__InfluenzaA__AHL96811

SEQ ID NO: 177335 - RNA, 1410 nt, Artificial Sequence; identical to SEQ ID NO: 176403
  derived and/or modified sequence opt4 from neuraminidase__InfluenzaA__AHL96823

SEQ ID NO: 177336 - RNA, 1410 nt, Artificial Sequence; identical to SEQ ID NO: 174666
  derived and/or modified sequence opt4 from neuraminidase__InfluenzaA__AHL96847

SEQ ID NO: 177337 - RNA, 1410 nt, Artificial Sequence
  derived and/or modified sequence opt4 from neuraminidase__InfluenzaA__AHL96859
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177338 - RNA, 1410 nt, Artificial Sequence
  derived and/or modified sequence opt4 from neuraminidase__InfluenzaA__AHL96871
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucguggagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggaggugcugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagaagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177339 - RNA, 1410 nt, Artificial Sequence
  derived and/or modified sequence opt4 from neuraminidase__InfluenzaA__AHL96883
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagagcgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177340 - RNA, 1410 nt, Artificial Sequence; identical to SEQ ID NO: 176391
  derived and/or modified sequence opt4 from neuraminidase__InfluenzaA__AHL96895

SEQ ID NO: 177341 - RNA, 1410 nt, Artificial Sequence
  derived and/or modified sequence opt4 from neuraminidase__InfluenzaA__AHL96907
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucguggagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggaggugcugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177342 - RNA, 1410 nt, Artificial Sequence; identical to SEQ ID NO: 176403
  derived and/or modified sequence opt4 from neuraminidase__InfluenzaA__AHL96919

SEQ ID NO: 177343 - RNA, 1410 nt, Artificial Sequence; identical to SEQ ID NO: 176403
  derived and/or modified sequence opt4 from neuraminidase__InfluenzaA__AHL96931

SEQ ID NO: 177344 - RNA, 1410 nt, Artificial Sequence; identical to SEQ ID NO: 176403
  derived and/or modified sequence opt4 from neuraminidase__InfluenzaA__AHL96943

SEQ ID NO: 177345 - RNA, 1410 nt, Artificial Sequence
  derived and/or modified sequence opt4 from neuraminidase__InfluenzaA__AHL96955
augaaccccaaccagaagaucaucaccaucggcagcgugagccugaccaucagcaccaucugcuucuucaugcagaucgccauccugaucaccaccgugacccugcacuucaagcaguacgaguucaacagccccagcaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcaacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177346 - RNA, 1410 nt, Artificial Sequence; identical to SEQ ID NO: 177244
  derived and/or modified sequence opt4 from neuraminidase__InfluenzaA__AHL96967

SEQ ID NO: 177347 - RNA, 1410 nt, Artificial Sequence
  derived and/or modified sequence opt4 from neuraminidase__InfluenzaA__AHL96979
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaacaucaugcccaucuga

SEQ ID NO: 177348 - RNA, 1410 nt, Artificial Sequence; identical to SEQ ID NO: 176403
  derived and/or modified sequence opt4 from neuraminidase__InfluenzaA__AHL96991

SEQ ID NO: 177349 - RNA, 1410 nt, Artificial Sequence; identical to SEQ ID NO: 174666
  derived and/or modified sequence opt4 from neuraminidase__InfluenzaA__AHL97003

SEQ ID NO: 177350 - RNA, 1410 nt, Artificial Sequence
  derived and/or modified sequence opt4 from neuraminidase__InfluenzaA__AHL97015
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacagaucaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177351 - RNA, 1410 nt, Artificial Sequence; identical to SEQ ID NO: 174666
  derived and/or modified sequence opt4 from neuraminidase__InfluenzaA__AHL97027

SEQ ID NO: 177352 - RNA, 1410 nt, Artificial Sequence
  derived and/or modified sequence opt4 from neuraminidase__InfluenzaA__AHL97039
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcaacgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177353 - RNA, 1410 nt, Artificial Sequence; identical to SEQ ID NO: 174666
  derived and/or modified sequence opt4 from neuraminidase__InfluenzaA__AHL97051

SEQ ID NO: 177354 - RNA, 1410 nt, Artificial Sequence
  derived and/or modified sequence opt4 from neuraminidase__InfluenzaA__AHL97063
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugggccccaacaacgaggagggcggccacggcgugaagggcugggccuucgacgacggcaacgacguguggaugggcagaaccaucaacgagaccagcagacugggcuacgagaccuucaaggugaucgacggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177355 - RNA, 1410 nt, Artificial Sequence; identical to SEQ ID NO: 174666
  derived and/or modified sequence opt4 from neuraminidase__InfluenzaA__AHL97075

SEQ ID NO: 177356 - RNA, 1410 nt, Artificial Sequence; identical to SEQ ID NO: 176391
  derived and/or modified sequence opt4 from neuraminidase__InfluenzaA__AHL97087

SEQ ID NO: 177357 - RNA, 1410 nt, Artificial Sequence; identical to SEQ ID NO: 175895
  derived and/or modified sequence opt4 from neuraminidase__InfluenzaA__AHL97099

SEQ ID NO: 177358 - RNA, 1410 nt, Artificial Sequence; identical to SEQ ID NO: 174666
  derived and/or modified sequence opt4 from neuraminidase__InfluenzaA__AHL97111

SEQ ID NO: 177359 - RNA, 1410 nt, Artificial Sequence
  derived and/or modified sequence opt4 from neuraminidase__InfluenzaA__AHL97123
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaagaaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177360 - RNA, 1410 nt, Artificial Sequence; identical to SEQ ID NO: 176423
  derived and/or modified sequence opt4 from neuraminidase__InfluenzaA__AHL97135

SEQ ID NO: 177361 - RNA, 1410 nt, Artificial Sequence
  derived and/or modified sequence opt4 from neuraminidase__InfluenzaA__AHL97147
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177362 - RNA, 1410 nt, Artificial Sequence; identical to SEQ ID NO: 174666
  derived and/or modified sequence opt4 from neuraminidase__InfluenzaA__AHL97159

SEQ ID NO: 177363 - RNA, 1410 nt, Artificial Sequence; identical to SEQ ID NO: 174666
  derived and/or modified sequence opt4 from neuraminidase__InfluenzaA__AHL97171

SEQ ID NO: 177364 - RNA, 1410 nt, Artificial Sequence; identical to SEQ ID NO: 174666
  derived and/or modified sequence opt4 from neuraminidase__InfluenzaA__AHL97183

SEQ ID NO: 177365 - RNA, 1410 nt, Artificial Sequence; identical to SEQ ID NO: 174666
  derived and/or modified sequence opt4 from neuraminidase__InfluenzaA__AHL97195

SEQ ID NO: 177366 - RNA, 1410 nt, Artificial Sequence; identical to SEQ ID NO: 174666
  derived and/or modified sequence opt4 from neuraminidase__InfluenzaA__AHL97207

SEQ ID NO: 177367 - RNA, 1410 nt, Artificial Sequence; identical to SEQ ID NO: 174666
  derived and/or modified sequence opt4 from neuraminidase__InfluenzaA__AHL97219

SEQ ID NO: 177368 - RNA, 1410 nt, Artificial Sequence
  derived and/or modified sequence opt4 from neuraminidase__InfluenzaA__AHL97231
augaaccccaaccagaagaucaucaccaucggcagcgugagccugaccaucagcaccaucugcuucuucaugcagaucgccauccugaucaccaccgugacccugcacuucaagcaguacgacuucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcgugaucagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucggcggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177369 - RNA, 1410 nt, Artificial Sequence
  derived and/or modified sequence opt4 from neuraminidase__InfluenzaA__AHL97243
augaaccccaaccagaagaucaucaccaucggcagcgugagccugaccaucagcaccaucugcuucuucaugcagaucgccauccugaucaccaccgugacccugaacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177370 - RNA, 1410 nt, Artificial Sequence; identical to SEQ ID NO: 175895
  derived and/or modified sequence opt4 from neuraminidase__InfluenzaA__AHL97255

SEQ ID NO: 177371 - RNA, 1410 nt, Artificial Sequence
  derived and/or modified sequence opt4 from neuraminidase__InfluenzaA__AHL97267
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177372 - RNA, 1410 nt, Artificial Sequence; identical to SEQ ID NO: 174666
  derived and/or modified sequence opt4 from neuraminidase__InfluenzaA__AHL97279

SEQ ID NO: 177373 - RNA, 1410 nt, Artificial Sequence; identical to SEQ ID NO: 177256
  derived and/or modified sequence opt4 from neuraminidase__InfluenzaA__AHL97291

SEQ ID NO: 177374 - RNA, 1410 nt, Artificial Sequence; identical to SEQ ID NO: 177244
  derived and/or modified sequence opt4 from neuraminidase__InfluenzaA__AHL97303

SEQ ID NO: 177375 - RNA, 1410 nt, Artificial Sequence
  derived and/or modified sequence opt4 from neuraminidase__InfluenzaA__AHL97339
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaaccagcuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcagagccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177376 - RNA, 1410 nt, Artificial Sequence; identical to SEQ ID NO: 176391
  derived and/or modified sequence opt4 from neuraminidase__InfluenzaA__AHL97351

SEQ ID NO: 177377 - RNA, 1410 nt, Artificial Sequence; identical to SEQ ID NO: 177256
  derived and/or modified sequence opt4 from neuraminidase__InfluenzaA__AHL97363

SEQ ID NO: 177378 - RNA, 1410 nt, Artificial Sequence; identical to SEQ ID NO: 174666
  derived and/or modified sequence opt4 from neuraminidase__InfluenzaA__AHL97387

SEQ ID NO: 177379 - RNA, 1410 nt, Artificial Sequence
  derived and/or modified sequence opt4 from neuraminidase__InfluenzaA__AHL97399
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucauguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcagaagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177380 - RNA, 1410 nt, Artificial Sequence; identical to SEQ ID NO: 175895
  derived and/or modified sequence opt4 from neuraminidase__InfluenzaA__AHL97411

SEQ ID NO: 177381 - RNA, 1410 nt, Artificial Sequence
  derived and/or modified sequence opt4 from neuraminidase__InfluenzaA__AHL97423
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacauguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177382 - RNA, 1410 nt, Artificial Sequence
  derived and/or modified sequence opt4 from neuraminidase__InfluenzaA__AHL97447
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177383 - RNA, 1410 nt, Artificial Sequence; identical to SEQ ID NO: 174666
  derived and/or modified sequence opt4 from neuraminidase__InfluenzaA__AHL97459

SEQ ID NO: 177384 - RNA, 1410 nt, Artificial Sequence; identical to SEQ ID NO: 177256
  derived and/or modified sequence opt4 from neuraminidase__InfluenzaA__AHL97471

SEQ ID NO: 177385 - RNA, 1410 nt, Artificial Sequence; identical to SEQ ID NO: 176391
  derived and/or modified sequence opt4 from neuraminidase__InfluenzaA__AHL97483

SEQ ID NO: 177386 - RNA, 1410 nt, Artificial Sequence; identical to SEQ ID NO: 174666
  derived and/or modified sequence opt4 from neuraminidase__InfluenzaA__AHL97496

SEQ ID NO: 177387 - RNA, 1410 nt, Artificial Sequence; identical to SEQ ID NO: 174666
  derived and/or modified sequence opt4 from neuraminidase__InfluenzaA__AHL97508

SEQ ID NO: 177388 - RNA, 1410 nt, Artificial Sequence
  derived and/or modified sequence opt4 from neuraminidase__InfluenzaA__AHL97520
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaccugccccaagcccgccgaguacagaaacuggagcaagccccagugcggcaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177389 - RNA, 1410 nt, Artificial Sequence; identical to SEQ ID NO: 174666
  derived and/or modified sequence opt4 from neuraminidase__InfluenzaA__AHL97532

SEQ ID NO: 177390 - RNA, 1410 nt, Artificial Sequence; identical to SEQ ID NO: 174666
  derived and/or modified sequence opt4 from neuraminidase__InfluenzaA__AHL97544

SEQ ID NO: 177391 - RNA, 1410 nt, Artificial Sequence; identical to SEQ ID NO: 176391
  derived and/or modified sequence opt4 from neuraminidase__InfluenzaA__AHL97556

SEQ ID NO: 177392 - RNA, 1410 nt, Artificial Sequence
  derived and/or modified sequence opt4 from neuraminidase__InfluenzaA__AHL97568
augaaccccaaccagaagaucaucaccaucggcagcgugagccugaccaucagcgccaucugcuucuucaugcagaucgccauccugaucaccaccgugacccugagauucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaccaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177393 - RNA, 1410 nt, Artificial Sequence; identical to SEQ ID NO: 177306
  derived and/or modified sequence opt4 from neuraminidase__InfluenzaA__AHL97580

SEQ ID NO: 177394 - RNA, 1410 nt, Artificial Sequence
  derived and/or modified sequence opt4 from neuraminidase__InfluenzaA__AHL97592
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcgugagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugggccccaacaacgaggagggcggccacggcgugaagggcugggccuucgacgacggcaacgacguguggaugggcagaaccaucaacgagaccagcagaagcggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177395 - RNA, 1410 nt, Artificial Sequence; identical to SEQ ID NO: 174666
  derived and/or modified sequence opt4 from neuraminidase__InfluenzaA__AHL97604

SEQ ID NO: 177396 - RNA, 1410 nt, Artificial Sequence
  derived and/or modified sequence opt4 from neuraminidase__InfluenzaA__AHL97616
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggaggugcugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177397 - RNA, 1410 nt, Artificial Sequence; identical to SEQ ID NO: 177256
  derived and/or modified sequence opt4 from neuraminidase__InfluenzaA__AHL97628

SEQ ID NO: 177398 - RNA, 1410 nt, Artificial Sequence; identical to SEQ ID NO: 174666
  derived and/or modified sequence opt4 from neuraminidase__InfluenzaA__AHL97640

SEQ ID NO: 177399 - RNA, 1410 nt, Artificial Sequence; identical to SEQ ID NO: 176414
  derived and/or modified sequence opt4 from neuraminidase__InfluenzaA__AHL97652

SEQ ID NO: 177400 - RNA, 1410 nt, Artificial Sequence; identical to SEQ ID NO: 176414
  derived and/or modified sequence opt4 from neuraminidase__InfluenzaA__AHL97664

SEQ ID NO: 177401 - RNA, 1410 nt, Artificial Sequence; identical to SEQ ID NO: 175895
  derived and/or modified sequence opt4 from neuraminidase__InfluenzaA__AHL97676

SEQ ID NO: 177402 - RNA, 1410 nt, Artificial Sequence; identical to SEQ ID NO: 174666
  derived and/or modified sequence opt4 from neuraminidase__InfluenzaA__AHL97688

SEQ ID NO: 177403 - RNA, 1410 nt, Artificial Sequence; identical to SEQ ID NO: 176391
  derived and/or modified sequence opt4 from neuraminidase__InfluenzaA__AHL97700

SEQ ID NO: 177404 - RNA, 1410 nt, Artificial Sequence
  derived and/or modified sequence opt4 from neuraminidase__InfluenzaA__AHL97712
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcaccagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177405 - RNA, 1410 nt, Artificial Sequence; identical to SEQ ID NO: 176391
  derived and/or modified sequence opt4 from neuraminidase__InfluenzaA__AHL97724

SEQ ID NO: 177406 - RNA, 1410 nt, Artificial Sequence; identical to SEQ ID NO: 174666
  derived and/or modified sequence opt4 from neuraminidase__InfluenzaA__AHL97736

SEQ ID NO: 177407 - RNA, 1410 nt, Artificial Sequence
  derived and/or modified sequence opt4 from neuraminidase__InfluenzaA__AHL97760
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacgagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177408 - RNA, 1410 nt, Artificial Sequence
  derived and/or modified sequence opt4 from neuraminidase__InfluenzaA__AHL97772
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcguggugguguucugcggcaccagcggcaccuacggcaccggcagcuggcccgacggcgccgaccugaaccugaugcccaucuga

SEQ ID NO: 177409 - RNA, 1410 nt, Artificial Sequence; identical to SEQ ID NO: 175895
  derived and/or modified sequence opt4 from neuraminidase__InfluenzaA__AHL97784

SEQ ID NO: 177410 - RNA, 1410 nt, Artificial Sequence; identical to SEQ ID NO: 174666
  derived and/or modified sequence opt4 from neuraminidase__InfluenzaA__AHL97796

SEQ ID NO: 177411 - RNA, 1410 nt, Artificial Sequence; identical to SEQ ID NO: 174666
  derived and/or modified sequence opt4 from neuraminidase__InfluenzaA__AHL97808

SEQ ID NO: 177412 - RNA, 1410 nt, Artificial Sequence; identical to SEQ ID NO: 174666
  derived and/or modified sequence opt4 from neuraminidase__InfluenzaA__AHL97820

SEQ ID NO: 177413 - RNA, 1410 nt, Artificial Sequence
  derived and/or modified sequence opt4 from neuraminidase__InfluenzaA__AHL97832
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaagcuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177414 - RNA, 1410 nt, Artificial Sequence; identical to SEQ ID NO: 174666
  derived and/or modified sequence opt4 from neuraminidase__InfluenzaA__AHL97844

SEQ ID NO: 177415 - RNA, 1410 nt, Artificial Sequence; identical to SEQ ID NO: 177407
  derived and/or modified sequence opt4 from neuraminidase__InfluenzaA__AHL97856

SEQ ID NO: 177416 - RNA, 1410 nt, Artificial Sequence; identical to SEQ ID NO: 174666
  derived and/or modified sequence opt4 from neuraminidase__InfluenzaA__AHL97868

SEQ ID NO: 177417 - RNA, 1410 nt, Artificial Sequence; identical to SEQ ID NO: 176391
  derived and/or modified sequence opt4 from neuraminidase__InfluenzaA__AHL97880

SEQ ID NO: 177418 - RNA, 1410 nt, Artificial Sequence; identical to SEQ ID NO: 174666
  derived and/or modified sequence opt4 from neuraminidase__InfluenzaA__AHL97892

SEQ ID NO: 177419 - RNA, 1410 nt, Artificial Sequence; identical to SEQ ID NO: 174666
  derived and/or modified sequence opt4 from neuraminidase__InfluenzaA__AHL97904

SEQ ID NO: 177420 - RNA, 1410 nt, Artificial Sequence; identical to SEQ ID NO: 176403
  derived and/or modified sequence opt4 from neuraminidase__InfluenzaA__AHL97916

SEQ ID NO: 177421 - RNA, 1410 nt, Artificial Sequence; identical to SEQ ID NO: 174666
  derived and/or modified sequence opt4 from neuraminidase__InfluenzaA__AHL97928

SEQ ID NO: 177422 - RNA, 1410 nt, Artificial Sequence; identical to SEQ ID NO: 177382
  derived and/or modified sequence opt4 from neuraminidase__InfluenzaA__AHL97952

SEQ ID NO: 177423 - RNA, 1410 nt, Artificial Sequence; identical to SEQ ID NO: 174666
  derived and/or modified sequence opt4 from neuraminidase__InfluenzaA__AHL97964

SEQ ID NO: 177424 - RNA, 1410 nt, Artificial Sequence; identical to SEQ ID NO: 174666
  derived and/or modified sequence opt4 from neuraminidase__InfluenzaA__AHL97976

SEQ ID NO: 177425 - RNA, 1410 nt, Artificial Sequence; identical to SEQ ID NO: 174666
  derived and/or modified sequence opt4 from neuraminidase__InfluenzaA__AHL97988

SEQ ID NO: 177426 - RNA, 1410 nt, Artificial Sequence
  derived and/or modified sequence opt4 from neuraminidase__InfluenzaA__AHL98000
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccacgagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaaggacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177427 - RNA, 1410 nt, Artificial Sequence
  derived and/or modified sequence opt4 from neuraminidase__InfluenzaA__AHL98012
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggaggugcugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177428 - RNA, 1410 nt, Artificial Sequence; identical to SEQ ID NO: 176403
  derived and/or modified sequence opt4 from neuraminidase__InfluenzaA__AHL98048

SEQ ID NO: 177429 - RNA, 1410 nt, Artificial Sequence; identical to SEQ ID NO: 176403
  derived and/or modified sequence opt4 from neuraminidase__InfluenzaA__AHL98060

SEQ ID NO: 177430 - RNA, 1410 nt, Artificial Sequence; identical to SEQ ID NO: 176403
  derived and/or modified sequence opt4 from neuraminidase__InfluenzaA__AHL98072

SEQ ID NO: 177431 - RNA, 1410 nt, Artificial Sequence; identical to SEQ ID NO: 174666
  derived and/or modified sequence opt4 from neuraminidase__InfluenzaA__AHL98084

SEQ ID NO: 177432 - RNA, 1410 nt, Artificial Sequence; identical to SEQ ID NO: 176403
  derived and/or modified sequence opt4 from neuraminidase__InfluenzaA__AHL98096

SEQ ID NO: 177433 - RNA, 1410 nt, Artificial Sequence; identical to SEQ ID NO: 174666
  derived and/or modified sequence opt4 from neuraminidase__InfluenzaA__AHL98119

SEQ ID NO: 177434 - RNA, 1410 nt, Artificial Sequence; identical to SEQ ID NO: 174666
  derived and/or modified sequence opt4 from neuraminidase__InfluenzaA__AHL98131

SEQ ID NO: 177435 - RNA, 1410 nt, Artificial Sequence; identical to SEQ ID NO: 174666
  derived and/or modified sequence opt4 from neuraminidase__InfluenzaA__AHL98143

SEQ ID NO: 177436 - RNA, 1410 nt, Artificial Sequence
  derived and/or modified sequence opt4 from neuraminidase__InfluenzaA__AHL98155
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaacagcaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177437 - RNA, 1410 nt, Artificial Sequence; identical to SEQ ID NO: 174666
  derived and/or modified sequence opt4 from neuraminidase__InfluenzaA__AHL98167

SEQ ID NO: 177438 - RNA, 1410 nt, Artificial Sequence; identical to SEQ ID NO: 174666
  derived and/or modified sequence opt4 from neuraminidase__InfluenzaA__AHL98179

SEQ ID NO: 177439 - RNA, 1410 nt, Artificial Sequence; identical to SEQ ID NO: 174666
  derived and/or modified sequence opt4 from neuraminidase__InfluenzaA__AHL98191

SEQ ID NO: 177440 - RNA, 1410 nt, Artificial Sequence; identical to SEQ ID NO: 176403
  derived and/or modified sequence opt4 from neuraminidase__InfluenzaA__AHL98215

SEQ ID NO: 177441 - RNA, 1410 nt, Artificial Sequence
  derived and/or modified sequence opt4 from neuraminidase__InfluenzaA__AHL98227
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgacaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177442 - RNA, 1410 nt, Artificial Sequence; identical to SEQ ID NO: 174666
  derived and/or modified sequence opt4 from neuraminidase__InfluenzaA__AHL98239

SEQ ID NO: 177443 - RNA, 1410 nt, Artificial Sequence; identical to SEQ ID NO: 174666
  derived and/or modified sequence opt4 from neuraminidase__InfluenzaA__AHL98251

SEQ ID NO: 177444 - RNA, 1410 nt, Artificial Sequence; identical to SEQ ID NO: 176414
  derived and/or modified sequence opt4 from neuraminidase__InfluenzaA__AHL98263

SEQ ID NO: 177445 - RNA, 1410 nt, Artificial Sequence; identical to SEQ ID NO: 174666
  derived and/or modified sequence opt4 from neuraminidase__InfluenzaA__AHL98275

SEQ ID NO: 177446 - RNA, 1410 nt, Artificial Sequence; identical to SEQ ID NO: 177312
  derived and/or modified sequence opt4 from neuraminidase__InfluenzaA__AHL98287

SEQ ID NO: 177447 - RNA, 1410 nt, Artificial Sequence
  derived and/or modified sequence opt4 from neuraminidase__InfluenzaA__AHL98298
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucggcagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177448 - RNA, 1410 nt, Artificial Sequence; identical to SEQ ID NO: 174666
  derived and/or modified sequence opt4 from neuraminidase__InfluenzaA__AHL98310

SEQ ID NO: 177449 - RNA, 1410 nt, Artificial Sequence; identical to SEQ ID NO: 174666
  derived and/or modified sequence opt4 from neuraminidase__InfluenzaA__AHL98322

SEQ ID NO: 177450 - RNA, 1410 nt, Artificial Sequence
  derived and/or modified sequence opt4 from neuraminidase__InfluenzaA__AHL98334
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgaggugguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177451 - RNA, 1410 nt, Artificial Sequence
  derived and/or modified sequence opt4 from neuraminidase__InfluenzaA__AHL98346
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 177452 - RNA, 1410 nt, Artificial Sequence; identical to SEQ ID NO: 174666
  derived and/or modified sequence opt4 from neuraminidase__InfluenzaA__AHL98357

SEQ ID NO: 177453 - RNA, 1410 nt, Artificial Sequence; identical to SEQ ID NO: 176414
  derived and/or modified sequence opt4 from neuraminidase__InfluenzaA__AHL98369

SEQ ID NO: 177454 - RNA, 1410 nt, Artificial Sequence
  derived and/or modified sequence opt4 from neuraminidase__InfluenzaA__AHL98381
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacaugcacagcaacaacaccgugagagacagaacccccuacagaacccugcugaugagcgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaccgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177455 - RNA, 1410 nt, Artificial Sequence
  derived and/or modified sequence opt4 from neuraminidase__InfluenzaA__AHL98393
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgaccagcacaucgaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177456 - RNA, 1410 nt, Artificial Sequence; identical to SEQ ID NO: 174666
  derived and/or modified sequence opt4 from neuraminidase__InfluenzaA__AHL98405

SEQ ID NO: 177457 - RNA, 1410 nt, Artificial Sequence; identical to SEQ ID NO: 174666
  derived and/or modified sequence opt4 from neuraminidase__InfluenzaA__AHL98417

SEQ ID NO: 177458 - RNA, 1410 nt, Artificial Sequence; identical to SEQ ID NO: 174666
  derived and/or modified sequence opt4 from neuraminidase__InfluenzaA__AHL98429

SEQ ID NO: 177459 - RNA, 1410 nt, Artificial Sequence
  derived and/or modified sequence opt4 from neuraminidase__InfluenzaA__AHL98452
augaaccccacccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177460 - RNA, 1410 nt, Artificial Sequence
  derived and/or modified sequence opt4 from neuraminidase__InfluenzaA__AHL98474
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccaacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177461 - RNA, 1410 nt, Artificial Sequence
  derived and/or modified sequence opt4 from neuraminidase__InfluenzaA__AHL98485
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcauccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177462 - RNA, 1410 nt, Artificial Sequence; identical to SEQ ID NO: 175895
  derived and/or modified sequence opt4 from neuraminidase__InfluenzaA__AHL98497

SEQ ID NO: 177463 - RNA, 1410 nt, Artificial Sequence; identical to SEQ ID NO: 174666
  derived and/or modified sequence opt4 from neuraminidase__InfluenzaA__AHL98509

SEQ ID NO: 177464 - RNA, 1410 nt, Artificial Sequence; identical to SEQ ID NO: 174666
  derived and/or modified sequence opt4 from neuraminidase__InfluenzaA__AHL98521

SEQ ID NO: 177465 - RNA, 1410 nt, Artificial Sequence; identical to SEQ ID NO: 175895
  derived and/or modified sequence opt4 from neuraminidase__InfluenzaA__AHL98533

SEQ ID NO: 177466 - RNA, 1410 nt, Artificial Sequence; identical to SEQ ID NO: 174666
  derived and/or modified sequence opt4 from neuraminidase__InfluenzaA__AHL98545

SEQ ID NO: 177467 - RNA, 1410 nt, Artificial Sequence; identical to SEQ ID NO: 174666
  derived and/or modified sequence opt4 from neuraminidase__InfluenzaA__AHL98557

SEQ ID NO: 177468 - RNA, 1410 nt, Artificial Sequence; identical to SEQ ID NO: 174666
  derived and/or modified sequence opt4 from neuraminidase__InfluenzaA__AHL98569

SEQ ID NO: 177469 - RNA, 1410 nt, Artificial Sequence
  derived and/or modified sequence opt4 from neuraminidase__InfluenzaA__AHL98581
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcaacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177470 - RNA, 1410 nt, Artificial Sequence; identical to SEQ ID NO: 174666
  derived and/or modified sequence opt4 from neuraminidase__InfluenzaA__AHL98593

SEQ ID NO: 177471 - RNA, 1410 nt, Artificial Sequence; identical to SEQ ID NO: 176403
  derived and/or modified sequence opt4 from neuraminidase__InfluenzaA__AHL98605

SEQ ID NO: 177472 - RNA, 1410 nt, Artificial Sequence; identical to SEQ ID NO: 175895
  derived and/or modified sequence opt4 from neuraminidase__InfluenzaA__AHL98617

SEQ ID NO: 177473 - RNA, 1410 nt, Artificial Sequence; identical to SEQ ID NO: 175895
  derived and/or modified sequence opt4 from neuraminidase__InfluenzaA__AHL98629

SEQ ID NO: 177474 - RNA, 1410 nt, Artificial Sequence; identical to SEQ ID NO: 174666
  derived and/or modified sequence opt4 from neuraminidase__InfluenzaA__AHL98641

SEQ ID NO: 177475 - RNA, 1410 nt, Artificial Sequence; identical to SEQ ID NO: 177244
  derived and/or modified sequence opt4 from neuraminidase__InfluenzaA__AHL98653

SEQ ID NO: 177476 - RNA, 1410 nt, Artificial Sequence; identical to SEQ ID NO: 174666
  derived and/or modified sequence opt4 from neuraminidase__InfluenzaA__AHL98665

SEQ ID NO: 177477 - RNA, 1410 nt, Artificial Sequence
  derived and/or modified sequence opt4 from neuraminidase__InfluenzaA__AHL98677
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaaccccccacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcaacgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177478 - RNA, 1410 nt, Artificial Sequence; identical to SEQ ID NO: 176414
  derived and/or modified sequence opt4 from neuraminidase__InfluenzaA__AHL98689

SEQ ID NO: 177479 - RNA, 1410 nt, Artificial Sequence
  derived and/or modified sequence opt4 from neuraminidase__InfluenzaA__AHL98702
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177480 - RNA, 1410 nt, Artificial Sequence; identical to SEQ ID NO: 175909
  derived and/or modified sequence opt4 from neuraminidase__InfluenzaA__AHL98714

SEQ ID NO: 177481 - RNA, 1410 nt, Artificial Sequence
  derived and/or modified sequence opt4 from neuraminidase__InfluenzaA__AHL98725
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcggcaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcaacgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacgagaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177482 - RNA, 1410 nt, Artificial Sequence; identical to SEQ ID NO: 176403
  derived and/or modified sequence opt4 from neuraminidase__InfluenzaA__AHL98737

SEQ ID NO: 177483 - RNA, 1410 nt, Artificial Sequence; identical to SEQ ID NO: 176391
  derived and/or modified sequence opt4 from neuraminidase__InfluenzaA__AHL98749

SEQ ID NO: 177484 - RNA, 1410 nt, Artificial Sequence; identical to SEQ ID NO: 176403
  derived and/or modified sequence opt4 from neuraminidase__InfluenzaA__AHL98761

SEQ ID NO: 177485 - RNA, 1410 nt, Artificial Sequence
  derived and/or modified sequence opt4 from neuraminidase__InfluenzaA__AHL98773
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcaacaucugggugaccagagagcccuacgugagcugcgaccccgacaagugcuaccaguucgcccugggccagggcaccacccugaacaacgugcacagcaacaacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177486 - RNA, 1410 nt, Artificial Sequence; identical to SEQ ID NO: 176423
  derived and/or modified sequence opt4 from neuraminidase__InfluenzaA__AHL98785

SEQ ID NO: 177487 - RNA, 1410 nt, Artificial Sequence
  derived and/or modified sequence opt4 from neuraminidase__InfluenzaA__AHL98797
augaaccccaaccagaagaucaucaccaucggcagcgugagccugaccaucagcaccaucugcuucuucacccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagaagcggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177488 - RNA, 1410 nt, Artificial Sequence; identical to SEQ ID NO: 174666
  derived and/or modified sequence opt4 from neuraminidase__InfluenzaA__AHL98809

SEQ ID NO: 177489 - RNA, 1410 nt, Artificial Sequence
  derived and/or modified sequence opt4 from neuraminidase__InfluenzaA__AHL98821
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacagaugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177490 - RNA, 1410 nt, Artificial Sequence; identical to SEQ ID NO: 174666
  derived and/or modified sequence opt4 from neuraminidase__InfluenzaA__AHL98833

SEQ ID NO: 177491 - RNA, 1410 nt, Artificial Sequence
  derived and/or modified sequence opt4 from neuraminidase__InfluenzaA__AHL98845
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaucaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177492 - RNA, 1410 nt, Artificial Sequence; identical to SEQ ID NO: 176403
  derived and/or modified sequence opt4 from neuraminidase__InfluenzaA__AHL98857

SEQ ID NO: 177493 - RNA, 1410 nt, Artificial Sequence; identical to SEQ ID NO: 176403
  derived and/or modified sequence opt4 from neuraminidase__InfluenzaA__AHL98869

SEQ ID NO: 177494 - RNA, 1410 nt, Artificial Sequence; identical to SEQ ID NO: 174666
  derived and/or modified sequence opt4 from neuraminidase__InfluenzaA__AHL98881

SEQ ID NO: 177495 - RNA, 1410 nt, Artificial Sequence
  derived and/or modified sequence opt4 from neuraminidase__InfluenzaA__AHL98893
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaagguguucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177496 - RNA, 1410 nt, Artificial Sequence; identical to SEQ ID NO: 176391
  derived and/or modified sequence opt4 from neuraminidase__InfluenzaA__AHL98905

SEQ ID NO: 177497 - RNA, 1410 nt, Artificial Sequence; identical to SEQ ID NO: 174666
  derived and/or modified sequence opt4 from neuraminidase__InfluenzaA__AHL98916

SEQ ID NO: 177498 - RNA, 1410 nt, Artificial Sequence; identical to SEQ ID NO: 176414
  derived and/or modified sequence opt4 from neuraminidase__InfluenzaA__AHL98928

SEQ ID NO: 177499 - RNA, 1410 nt, Artificial Sequence; identical to SEQ ID NO: 174666
  derived and/or modified sequence opt4 from neuraminidase__InfluenzaA__AHL98940

SEQ ID NO: 177500 - RNA, 1410 nt, Artificial Sequence; identical to SEQ ID NO: 174666
  derived and/or modified sequence opt4 from neuraminidase__InfluenzaA__AHL98952

SEQ ID NO: 177501 - RNA, 1410 nt, Artificial Sequence; identical to SEQ ID NO: 176391
  derived and/or modified sequence opt4 from neuraminidase__InfluenzaA__AHL98964

SEQ ID NO: 177502 - RNA, 1410 nt, Artificial Sequence
  derived and/or modified sequence opt4 from neuraminidase__InfluenzaA__AHL98976
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucguggagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggccagcuggagcaaggaggugcugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177503 - RNA, 1410 nt, Artificial Sequence; identical to SEQ ID NO: 176391
  derived and/or modified sequence opt4 from neuraminidase__InfluenzaA__AHL98988

SEQ ID NO: 177504 - RNA, 1410 nt, Artificial Sequence; identical to SEQ ID NO: 174666
  derived and/or modified sequence opt4 from neuraminidase__InfluenzaA__AHL99000

SEQ ID NO: 177505 - RNA, 1410 nt, Artificial Sequence; identical to SEQ ID NO: 174666
  derived and/or modified sequence opt4 from neuraminidase__InfluenzaA__AHL99012

SEQ ID NO: 177506 - RNA, 1410 nt, Artificial Sequence
  derived and/or modified sequence opt4 from neuraminidase__InfluenzaA__AHL99024
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcaucugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177507 - RNA, 1410 nt, Artificial Sequence; identical to SEQ ID NO: 175884
  derived and/or modified sequence opt4 from neuraminidase__InfluenzaA__AHL99036

SEQ ID NO: 177508 - RNA, 1410 nt, Artificial Sequence; identical to SEQ ID NO: 177306
  derived and/or modified sequence opt4 from neuraminidase__InfluenzaA__AHL99048

SEQ ID NO: 177509 - RNA, 1410 nt, Artificial Sequence; identical to SEQ ID NO: 174666
  derived and/or modified sequence opt4 from neuraminidase__InfluenzaA__AHL99060

SEQ ID NO: 177510 - RNA, 1410 nt, Artificial Sequence
  derived and/or modified sequence opt4 from neuraminidase__InfluenzaA__AHL99072
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177511 - RNA, 1410 nt, Artificial Sequence
  derived and/or modified sequence opt4 from neuraminidase__InfluenzaA__AHL99084
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacagaugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacaacaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177512 - RNA, 1410 nt, Artificial Sequence; identical to SEQ ID NO: 174666
  derived and/or modified sequence opt4 from neuraminidase__InfluenzaA__AHL99096

SEQ ID NO: 177513 - RNA, 1410 nt, Artificial Sequence; identical to SEQ ID NO: 174666
  derived and/or modified sequence opt4 from neuraminidase__InfluenzaA__AHL99108

SEQ ID NO: 177514 - RNA, 1410 nt, Artificial Sequence; identical to SEQ ID NO: 174666
  derived and/or modified sequence opt4 from neuraminidase__InfluenzaA__AHL99120

SEQ ID NO: 177515 - RNA, 1410 nt, Artificial Sequence; identical to SEQ ID NO: 174666
  derived and/or modified sequence opt4 from neuraminidase__InfluenzaA__AHL99132

SEQ ID NO: 177516 - RNA, 1410 nt, Artificial Sequence
  derived and/or modified sequence opt4 from neuraminidase__InfluenzaA__AHL99144
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcagaaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177517 - RNA, 1410 nt, Artificial Sequence; identical to SEQ ID NO: 174666
  derived and/or modified sequence opt4 from neuraminidase__InfluenzaA__AHL99156

SEQ ID NO: 177518 - RNA, 1410 nt, Artificial Sequence
  derived and/or modified sequence opt4 from neuraminidase__InfluenzaA__AHL99168
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaccaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177519 - RNA, 1410 nt, Artificial Sequence; identical to SEQ ID NO: 174666
  derived and/or modified sequence opt4 from neuraminidase__InfluenzaA__AHL99180

SEQ ID NO: 177520 - RNA, 1410 nt, Artificial Sequence; identical to SEQ ID NO: 175530
  derived and/or modified sequence opt4 from neuraminidase__InfluenzaA__AHL99204

SEQ ID NO: 177521 - RNA, 1410 nt, Artificial Sequence
  derived and/or modified sequence opt4 from neuraminidase__InfluenzaA__AHL99216
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccguggagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucaucgacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaagaaggagaccgaggugcuguggaccagcaacagcaucgugguguucugcggcaccagcggcaccuacggcaccggcagcuggcccgacggcgccgaccugaaccugaugcccaucuga

SEQ ID NO: 177522 - RNA, 1410 nt, Artificial Sequence; identical to SEQ ID NO: 174666
  derived and/or modified sequence opt4 from neuraminidase__InfluenzaA__AHL99228

SEQ ID NO: 177523 - RNA, 1410 nt, Artificial Sequence; identical to SEQ ID NO: 174666
  derived and/or modified sequence opt4 from neuraminidase__InfluenzaA__AHL99240

SEQ ID NO: 177524 - RNA, 1410 nt, Artificial Sequence; identical to SEQ ID NO: 174666
  derived and/or modified sequence opt4 from neuraminidase__InfluenzaA__AHL99252

SEQ ID NO: 177525 - RNA, 1410 nt, Artificial Sequence; identical to SEQ ID NO: 174666
  derived and/or modified sequence opt4 from neuraminidase__InfluenzaA__AHL99264

SEQ ID NO: 177526 - RNA, 1410 nt, Artificial Sequence; identical to SEQ ID NO: 174666
  derived and/or modified sequence opt4 from neuraminidase__InfluenzaA__AHL99276

SEQ ID NO: 177527 - RNA, 1410 nt, Artificial Sequence; identical to SEQ ID NO: 176403
  derived and/or modified sequence opt4 from neuraminidase__InfluenzaA__AHL99288

SEQ ID NO: 177528 - RNA, 1410 nt, Artificial Sequence; identical to SEQ ID NO: 177306
  derived and/or modified sequence opt4 from neuraminidase__InfluenzaA__AHL99300

SEQ ID NO: 177529 - RNA, 1410 nt, Artificial Sequence; identical to SEQ ID NO: 174666
  derived and/or modified sequence opt4 from neuraminidase__InfluenzaA__AHL99312

SEQ ID NO: 177530 - RNA, 1410 nt, Artificial Sequence
  derived and/or modified sequence opt4 from neuraminidase__InfluenzaA__AHL99324
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugauccugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177531 - RNA, 1410 nt, Artificial Sequence; identical to SEQ ID NO: 175909
  derived and/or modified sequence opt4 from neuraminidase__InfluenzaA__AHL99348

SEQ ID NO: 177532 - RNA, 1410 nt, Artificial Sequence; identical to SEQ ID NO: 175909
  derived and/or modified sequence opt4 from neuraminidase__InfluenzaA__AHL99359

SEQ ID NO: 177533 - RNA, 1410 nt, Artificial Sequence
  derived and/or modified sequence opt4 from neuraminidase__InfluenzaA__AHL99370
augaaccccaaccagaagaucaucaccaucggcagcgugagccugaccaucaccaccaucugcuucuucaugcagaucgccauccugaucaccaccgugacccugcacuucaagcaguacgaguucaacagcccccccaacaaccagaugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177534 - RNA, 1410 nt, Artificial Sequence; identical to SEQ ID NO: 174666
  derived and/or modified sequence opt4 from neuraminidase__InfluenzaA__AHL99393

SEQ ID NO: 177535 - RNA, 1410 nt, Artificial Sequence; identical to SEQ ID NO: 174666
  derived and/or modified sequence opt4 from neuraminidase__InfluenzaA__AHL99417

SEQ ID NO: 177536 - RNA, 1410 nt, Artificial Sequence; identical to SEQ ID NO: 174666
  derived and/or modified sequence opt4 from neuraminidase__InfluenzaA__AHL99429

SEQ ID NO: 177537 - RNA, 1410 nt, Artificial Sequence; identical to SEQ ID NO: 174666
  derived and/or modified sequence opt4 from neuraminidase__InfluenzaA__AHL99441

SEQ ID NO: 177538 - RNA, 1410 nt, Artificial Sequence; identical to SEQ ID NO: 174666
  derived and/or modified sequence opt4 from neuraminidase__InfluenzaA__AHL99453

SEQ ID NO: 177539 - RNA, 1410 nt, Artificial Sequence; identical to SEQ ID NO: 174666
  derived and/or modified sequence opt4 from neuraminidase__InfluenzaA__AHL99477

SEQ ID NO: 177540 - RNA, 1410 nt, Artificial Sequence; identical to SEQ ID NO: 177306
  derived and/or modified sequence opt4 from neuraminidase__InfluenzaA__AHL99489

SEQ ID NO: 177541 - RNA, 1410 nt, Artificial Sequence
  derived and/or modified sequence opt4 from neuraminidase__InfluenzaA__AHL99501
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaccgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177542 - RNA, 1410 nt, Artificial Sequence; identical to SEQ ID NO: 174666
  derived and/or modified sequence opt4 from neuraminidase__InfluenzaA__AHL99525

SEQ ID NO: 177543 - RNA, 1410 nt, Artificial Sequence
  derived and/or modified sequence opt4 from neuraminidase__InfluenzaA__AHL99537
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaaccagcuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177544 - RNA, 1410 nt, Artificial Sequence; identical to SEQ ID NO: 176403
  derived and/or modified sequence opt4 from neuraminidase__InfluenzaA__AHL99549

SEQ ID NO: 177545 - RNA, 1410 nt, Artificial Sequence; identical to SEQ ID NO: 174666
  derived and/or modified sequence opt4 from neuraminidase__InfluenzaA__AHL99561

SEQ ID NO: 177546 - RNA, 1410 nt, Artificial Sequence
  derived and/or modified sequence opt4 from neuraminidase__InfluenzaA__AHL99573
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccggcgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucaucgacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177547 - RNA, 1410 nt, Artificial Sequence
  derived and/or modified sequence opt4 from neuraminidase__InfluenzaA__AHL99585
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177548 - RNA, 1410 nt, Artificial Sequence
  derived and/or modified sequence opt4 from neuraminidase__InfluenzaA__AHL99597
augaaccccaaccagaagaucaucaccaucggcagcgugugcaugaccaucggcauggccaaccugauccugcagaucggcaacaucaucagcaucuggaucagccacagcauccaggugggcaaccagagccagaucgagaccugcaaccagagcgugaucaccuacgagaacaacaccugggugaaccagaccuacgugaacaucagcaacaccaacuucgccgugggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacgacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177549 - RNA, 1410 nt, Artificial Sequence
  derived and/or modified sequence opt4 from neuraminidase__InfluenzaA__AHL99608
augaaccccaaccagaagaucaucaccaucggcagcgugagccugaccaucagcaccaucugcguguucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177550 - RNA, 1410 nt, Artificial Sequence
  derived and/or modified sequence opt4 from neuraminidase__InfluenzaA__AHL99620
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177551 - RNA, 1410 nt, Artificial Sequence
  derived and/or modified sequence opt4 from neuraminidase__InfluenzaA__AHL99632
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaccaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177552 - RNA, 1410 nt, Artificial Sequence; identical to SEQ ID NO: 177341
  derived and/or modified sequence opt4 from neuraminidase__InfluenzaA__AHL99644

SEQ ID NO: 177553 - RNA, 1410 nt, Artificial Sequence
  derived and/or modified sequence opt4 from neuraminidase__InfluenzaA__AHL99668
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccguggagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucaucgacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177554 - RNA, 1410 nt, Artificial Sequence; identical to SEQ ID NO: 174666
  derived and/or modified sequence opt4 from neuraminidase__InfluenzaA__AHL99680

SEQ ID NO: 177555 - RNA, 1410 nt, Artificial Sequence
  derived and/or modified sequence opt4 from neuraminidase__InfluenzaA__AHL99692
augaaccccaaccagaagaucaucaccaucggcagcgugagccugaccaucagcaccaccugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177556 - RNA, 1410 nt, Artificial Sequence; identical to SEQ ID NO: 174666
  derived and/or modified sequence opt4 from neuraminidase__InfluenzaA__AHL99704

SEQ ID NO: 177557 - RNA, 1410 nt, Artificial Sequence; identical to SEQ ID NO: 174666
  derived and/or modified sequence opt4 from neuraminidase__InfluenzaA__AHL99716

SEQ ID NO: 177558 - RNA, 1410 nt, Artificial Sequence; identical to SEQ ID NO: 177548
  derived and/or modified sequence opt4 from neuraminidase__InfluenzaA__AHL99740

SEQ ID NO: 177559 - RNA, 1410 nt, Artificial Sequence
  derived and/or modified sequence opt4 from neuraminidase__InfluenzaA__AHL99751
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccguggagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177560 - RNA, 1410 nt, Artificial Sequence
  derived and/or modified sequence opt4 from neuraminidase__InfluenzaA__AHL99763
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaugaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177561 - RNA, 1410 nt, Artificial Sequence; identical to SEQ ID NO: 174666
  derived and/or modified sequence opt4 from neuraminidase__InfluenzaA__AHL99775

SEQ ID NO: 177562 - RNA, 1410 nt, Artificial Sequence
  derived and/or modified sequence opt4 from neuraminidase__InfluenzaA__AHL99787
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccgagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177563 - RNA, 1410 nt, Artificial Sequence
  derived and/or modified sequence opt4 from neuraminidase__InfluenzaA__AHL99799
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcaucugcagagacaacuggaagggcagcaacagacccaucguggacaucaacaucaaggaccacagcaucgugagcagcuacgugugcagcggccuggugggcgacacccccagaaagaacgacagcagcagcagcagccacugccugggccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177564 - RNA, 1410 nt, Artificial Sequence; identical to SEQ ID NO: 174666
  derived and/or modified sequence opt4 from neuraminidase__InfluenzaA__AHL99811

SEQ ID NO: 177565 - RNA, 1410 nt, Artificial Sequence
  derived and/or modified sequence opt4 from neuraminidase__InfluenzaA__AHL99823
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177566 - RNA, 1410 nt, Artificial Sequence
  derived and/or modified sequence opt4 from neuraminidase__InfluenzaA__AHL99835
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgcccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcugaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177567 - RNA, 1410 nt, Artificial Sequence; identical to SEQ ID NO: 174666
  derived and/or modified sequence opt4 from neuraminidase__InfluenzaA__AHL99847

SEQ ID NO: 177568 - RNA, 1410 nt, Artificial Sequence; identical to SEQ ID NO: 175895
  derived and/or modified sequence opt4 from neuraminidase__InfluenzaA__AHL99859

SEQ ID NO: 177569 - RNA, 1410 nt, Artificial Sequence
  derived and/or modified sequence opt4 from neuraminidase__InfluenzaA__AHL99871
augaaccccaaccagaagaucaucaccaucggcagcgugagccugaccaucagcaccaucugcuucuucaugcagaucgccauccugaccaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcagaaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177570 - RNA, 1410 nt, Artificial Sequence; identical to SEQ ID NO: 174666
  derived and/or modified sequence opt4 from neuraminidase__InfluenzaA__AHL99883

SEQ ID NO: 177571 - RNA, 1410 nt, Artificial Sequence; identical to SEQ ID NO: 177547
  derived and/or modified sequence opt4 from neuraminidase__InfluenzaA__AHL99895

SEQ ID NO: 177572 - RNA, 1410 nt, Artificial Sequence; identical to SEQ ID NO: 174666
  derived and/or modified sequence opt4 from neuraminidase__InfluenzaA__AHL99907

SEQ ID NO: 177573 - RNA, 1410 nt, Artificial Sequence; identical to SEQ ID NO: 174666
  derived and/or modified sequence opt4 from neuraminidase__InfluenzaA__AHL99919

SEQ ID NO: 177574 - RNA, 1410 nt, Artificial Sequence
  derived and/or modified sequence opt4 from neuraminidase__InfluenzaA__AHL99943
augaaccccaaccagaagaucaucaccaucggcagcgugagccugaccaucagcaccaucugcuucuucaugcagaucgccauccugaucaccaccgugacccugcacuucaagcagcacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177575 - RNA, 1410 nt, Artificial Sequence; identical to SEQ ID NO: 174666
  derived and/or modified sequence opt4 from neuraminidase__InfluenzaA__AHL99955

SEQ ID NO: 177576 - RNA, 1410 nt, Artificial Sequence
  derived and/or modified sequence opt4 from neuraminidase__InfluenzaA__AHL99967
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177577 - RNA, 1410 nt, Artificial Sequence
  derived and/or modified sequence opt4 from neuraminidase__InfluenzaA__AHL99979
augaaccccaaccagaagaucaucaccaucggcagcgugagccugaccaucagcaccaucugcuucuucaugcagaucgccauccugaucaccaccguggcccugcacuucaagcagcacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177578 - RNA, 1410 nt, Artificial Sequence; identical to SEQ ID NO: 177574
  derived and/or modified sequence opt4 from neuraminidase__InfluenzaA__AHL99991

SEQ ID NO: 177579 - RNA, 1410 nt, Artificial Sequence; identical to SEQ ID NO: 174666
  derived and/or modified sequence opt4 from neuraminidase__InfluenzaA__AHM00004

SEQ ID NO: 177580 - RNA, 1410 nt, Artificial Sequence; identical to SEQ ID NO: 174666
  derived and/or modified sequence opt4 from neuraminidase__InfluenzaA__AHM00016

SEQ ID NO: 177581 - RNA, 1410 nt, Artificial Sequence; identical to SEQ ID NO: 174666
  derived and/or modified sequence opt4 from neuraminidase__InfluenzaA__AHM00028

SEQ ID NO: 177582 - RNA, 1410 nt, Artificial Sequence; identical to SEQ ID NO: 177574
  derived and/or modified sequence opt4 from neuraminidase__InfluenzaA__AHM00040

SEQ ID NO: 177583 - RNA, 1410 nt, Artificial Sequence; identical to SEQ ID NO: 174666
  derived and/or modified sequence opt4 from neuraminidase__InfluenzaA__AHM00052

SEQ ID NO: 177584 - RNA, 1410 nt, Artificial Sequence; identical to SEQ ID NO: 175530
  derived and/or modified sequence opt4 from neuraminidase__InfluenzaA__AHM00064

SEQ ID NO: 177585 - RNA, 1410 nt, Artificial Sequence; identical to SEQ ID NO: 174666
  derived and/or modified sequence opt4 from neuraminidase__InfluenzaA__AHM00076

SEQ ID NO: 177586 - RNA, 1410 nt, Artificial Sequence; identical to SEQ ID NO: 174666
  derived and/or modified sequence opt4 from neuraminidase__InfluenzaA__AHM00088

SEQ ID NO: 177587 - RNA, 1410 nt, Artificial Sequence
  derived and/or modified sequence opt4 from neuraminidase__InfluenzaA__AHM00100
augaaccccaaccagaagaucaucaccaucggcagcaucugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcgugaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaccaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaacuga

SEQ ID NO: 177588 - RNA, 1410 nt, Artificial Sequence; identical to SEQ ID NO: 177510
  derived and/or modified sequence opt4 from neuraminidase__InfluenzaA__AHM00111

SEQ ID NO: 177589 - RNA, 1410 nt, Artificial Sequence; identical to SEQ ID NO: 177574
  derived and/or modified sequence opt4 from neuraminidase__InfluenzaA__AHM00123

SEQ ID NO: 177590 - RNA, 1410 nt, Artificial Sequence; identical to SEQ ID NO: 175895
  derived and/or modified sequence opt4 from neuraminidase__InfluenzaA__AHM00135

SEQ ID NO: 177591 - RNA, 1410 nt, Artificial Sequence; identical to SEQ ID NO: 176403
  derived and/or modified sequence opt4 from neuraminidase__InfluenzaA__AHM00147

SEQ ID NO: 177592 - RNA, 1410 nt, Artificial Sequence; identical to SEQ ID NO: 177574
  derived and/or modified sequence opt4 from neuraminidase__InfluenzaA__AHM00159

SEQ ID NO: 177593 - RNA, 1410 nt, Artificial Sequence; identical to SEQ ID NO: 174666
  derived and/or modified sequence opt4 from neuraminidase__InfluenzaA__AHM00171

SEQ ID NO: 177594 - RNA, 1410 nt, Artificial Sequence; identical to SEQ ID NO: 174666
  derived and/or modified sequence opt4 from neuraminidase__InfluenzaA__AHM00183

SEQ ID NO: 177595 - RNA, 1410 nt, Artificial Sequence
  derived and/or modified sequence opt4 from neuraminidase__InfluenzaA__AHM00195
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaaggugcuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177596 - RNA, 1410 nt, Artificial Sequence
  derived and/or modified sequence opt4 from neuraminidase__InfluenzaA__AHM00207
augaaccccaaccagaagaucaucaccaucggcagcgugagccugaccaucagcaccaucugcuucuucaugcagaucgccauccugaucaccaccgugacccugcacuucaagcagcacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcaacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177597 - RNA, 1410 nt, Artificial Sequence; identical to SEQ ID NO: 177574
  derived and/or modified sequence opt4 from neuraminidase__InfluenzaA__AHM00219

SEQ ID NO: 177598 - RNA, 1410 nt, Artificial Sequence; identical to SEQ ID NO: 174666
  derived and/or modified sequence opt4 from neuraminidase__InfluenzaA__AHM00231

SEQ ID NO: 177599 - RNA, 1410 nt, Artificial Sequence; identical to SEQ ID NO: 174666
  derived and/or modified sequence opt4 from neuraminidase__InfluenzaA__AHM00243

SEQ ID NO: 177600 - RNA, 1410 nt, Artificial Sequence; identical to SEQ ID NO: 174666
  derived and/or modified sequence opt4 from neuraminidase__InfluenzaA__AHM00255

SEQ ID NO: 177601 - RNA, 1410 nt, Artificial Sequence
  derived and/or modified sequence opt4 from neuraminidase__InfluenzaA__AHM00267
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggccagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177602 - RNA, 1410 nt, Artificial Sequence; identical to SEQ ID NO: 175895
  derived and/or modified sequence opt4 from neuraminidase__InfluenzaA__AHM00279

SEQ ID NO: 177603 - RNA, 1410 nt, Artificial Sequence; identical to SEQ ID NO: 174666
  derived and/or modified sequence opt4 from neuraminidase__InfluenzaA__AHM00291

SEQ ID NO: 177604 - RNA, 1410 nt, Artificial Sequence; identical to SEQ ID NO: 174666
  derived and/or modified sequence opt4 from neuraminidase__InfluenzaA__AHM00303

SEQ ID NO: 177605 - RNA, 1410 nt, Artificial Sequence; identical to SEQ ID NO: 174666
  derived and/or modified sequence opt4 from neuraminidase__InfluenzaA__AHM00315

SEQ ID NO: 177606 - RNA, 1410 nt, Artificial Sequence; identical to SEQ ID NO: 175895
  derived and/or modified sequence opt4 from neuraminidase__InfluenzaA__AHM00327

SEQ ID NO: 177607 - RNA, 1410 nt, Artificial Sequence; identical to SEQ ID NO: 175895
  derived and/or modified sequence opt4 from neuraminidase__InfluenzaA__AHM00339

SEQ ID NO: 177608 - RNA, 1410 nt, Artificial Sequence; identical to SEQ ID NO: 177574
  derived and/or modified sequence opt4 from neuraminidase__InfluenzaA__AHM00351

SEQ ID NO: 177609 - RNA, 1410 nt, Artificial Sequence; identical to SEQ ID NO: 177510
  derived and/or modified sequence opt4 from neuraminidase__InfluenzaA__AHM00363

SEQ ID NO: 177610 - RNA, 1410 nt, Artificial Sequence
  derived and/or modified sequence opt4 from neuraminidase__InfluenzaA__AHM00375
augaaccccaaccagaagaucaucaccaucggcagcgugagccugaccaucagcaccaucugcuucuucaugcagaucgccauccugaucaccaccgugacccugcacuucaagcagcacgaguucaacagcccccccaacaaccaggugaugcugugcgagcccaccaucaucgagagaaacaucaccgagaucguguaccugaccaacaccaccaucgagaaggaggugugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177611 - RNA, 1410 nt, Artificial Sequence
  derived and/or modified sequence opt4 from neuraminidase__InfluenzaA__AHM00398
augaaccccaaccagaagaucaucaccaucggcagcgugagccugaccaucagcaccaucugcuucuucaugcagaucgccauccugaucaccaccgugacccugcacuucaagcagcacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggagaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcagcagcaucgugguguucugcggcaccagcggcaccuacggcaccggcagcuggcccgacggcgccgaccugaaccugaugcccaucuga

SEQ ID NO: 177612 - RNA, 1410 nt, Artificial Sequence; identical to SEQ ID NO: 174666
  derived and/or modified sequence opt4 from neuraminidase__InfluenzaA__AHM00410

SEQ ID NO: 177613 - RNA, 1410 nt, Artificial Sequence
  derived and/or modified sequence opt4 from neuraminidase__InfluenzaA__AHM00422
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177614 - RNA, 1410 nt, Artificial Sequence
  derived and/or modified sequence opt4 from neuraminidase__InfluenzaA__AHM00434
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177615 - RNA, 1410 nt, Artificial Sequence; identical to SEQ ID NO: 174666
  derived and/or modified sequence opt4 from neuraminidase__InfluenzaA__AHM00446

SEQ ID NO: 177616 - RNA, 1410 nt, Artificial Sequence; identical to SEQ ID NO: 177574
  derived and/or modified sequence opt4 from neuraminidase__InfluenzaA__AHM00458

SEQ ID NO: 177617 - RNA, 1410 nt, Artificial Sequence; identical to SEQ ID NO: 177574
  derived and/or modified sequence opt4 from neuraminidase__InfluenzaA__AHM00470

SEQ ID NO: 177618 - RNA, 1410 nt, Artificial Sequence; identical to SEQ ID NO: 177574
  derived and/or modified sequence opt4 from neuraminidase__InfluenzaA__AHM00482

SEQ ID NO: 177619 - RNA, 1410 nt, Artificial Sequence; identical to SEQ ID NO: 177574
  derived and/or modified sequence opt4 from neuraminidase__InfluenzaA__AHM00494

SEQ ID NO: 177620 - RNA, 1410 nt, Artificial Sequence
  derived and/or modified sequence opt4 from neuraminidase__InfluenzaA__AHM00506
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugaacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177621 - RNA, 1410 nt, Artificial Sequence; identical to SEQ ID NO: 174666
  derived and/or modified sequence opt4 from neuraminidase__InfluenzaA__AHM00518

SEQ ID NO: 177622 - RNA, 1410 nt, Artificial Sequence
  derived and/or modified sequence opt4 from neuraminidase__InfluenzaA__AHM00530
augaaccccaaccagaagaucaucaccaucggcagcgugagccugaccaucagcaccaucugcuucagcaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177623 - RNA, 1410 nt, Artificial Sequence; identical to SEQ ID NO: 175895
  derived and/or modified sequence opt4 from neuraminidase__InfluenzaA__AHM00542

SEQ ID NO: 177624 - RNA, 1410 nt, Artificial Sequence
  derived and/or modified sequence opt4 from neuraminidase__InfluenzaA__AHM00546
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcaaguacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177625 - RNA, 1410 nt, Artificial Sequence
  derived and/or modified sequence opt4 from neuraminidase__InfluenzaA__AHM00558
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggaggugugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177626 - RNA, 1410 nt, Artificial Sequence; identical to SEQ ID NO: 174666
  derived and/or modified sequence opt4 from neuraminidase__InfluenzaA__AHM00570

SEQ ID NO: 177627 - RNA, 1410 nt, Artificial Sequence; identical to SEQ ID NO: 174666
  derived and/or modified sequence opt4 from neuraminidase__InfluenzaA__AHM00582

SEQ ID NO: 177628 - RNA, 1410 nt, Artificial Sequence
  derived and/or modified sequence opt4 from neuraminidase__InfluenzaA__AHM00594
augaaccccaaccagaagaucaucaccaucggcagcgugagccugaccaucagcaccaucugcuucuucaugcagaucgccauccugaucaccaccgugacccugcacuucaagcagcacgaguucaacagcccccccaacaaccaggugaugcugugcgagcccaccaucaucgagagaaacaucaccgagaucgugcaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177629 - RNA, 1410 nt, Artificial Sequence; identical to SEQ ID NO: 174666
  derived and/or modified sequence opt4 from neuraminidase__InfluenzaA__AHM00606

SEQ ID NO: 177630 - RNA, 1410 nt, Artificial Sequence; identical to SEQ ID NO: 174666
  derived and/or modified sequence opt4 from neuraminidase__InfluenzaA__AHM00618

SEQ ID NO: 177631 - RNA, 1410 nt, Artificial Sequence; identical to SEQ ID NO: 174666
  derived and/or modified sequence opt4 from neuraminidase__InfluenzaA__AHM00630

SEQ ID NO: 177632 - RNA, 1410 nt, Artificial Sequence; identical to SEQ ID NO: 174666
  derived and/or modified sequence opt4 from neuraminidase__InfluenzaA__AHM00642

SEQ ID NO: 177633 - RNA, 1410 nt, Artificial Sequence; identical to SEQ ID NO: 175895
  derived and/or modified sequence opt4 from neuraminidase__InfluenzaA__AHM00654

SEQ ID NO: 177634 - RNA, 1410 nt, Artificial Sequence; identical to SEQ ID NO: 174666
  derived and/or modified sequence opt4 from neuraminidase__InfluenzaA__AHM00666

SEQ ID NO: 177635 - RNA, 1410 nt, Artificial Sequence; identical to SEQ ID NO: 177574
  derived and/or modified sequence opt4 from neuraminidase__InfluenzaA__AHM00678

SEQ ID NO: 177636 - RNA, 1410 nt, Artificial Sequence; identical to SEQ ID NO: 175909
  derived and/or modified sequence opt4 from neuraminidase__InfluenzaA__AHM00690

SEQ ID NO: 177637 - RNA, 1410 nt, Artificial Sequence; identical to SEQ ID NO: 175895
  derived and/or modified sequence opt4 from neuraminidase__InfluenzaA__AHM00701

SEQ ID NO: 177638 - RNA, 1410 nt, Artificial Sequence
  derived and/or modified sequence opt4 from neuraminidase__InfluenzaA__AHM00713
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagagcgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177639 - RNA, 1410 nt, Artificial Sequence; identical to SEQ ID NO: 174666
  derived and/or modified sequence opt4 from neuraminidase__InfluenzaA__AHM00725

SEQ ID NO: 177640 - RNA, 1410 nt, Artificial Sequence; identical to SEQ ID NO: 174666
  derived and/or modified sequence opt4 from neuraminidase__InfluenzaA__AHM00737

SEQ ID NO: 177641 - RNA, 1410 nt, Artificial Sequence; identical to SEQ ID NO: 177574
  derived and/or modified sequence opt4 from neuraminidase__InfluenzaA__AHM00749

SEQ ID NO: 177642 - RNA, 1410 nt, Artificial Sequence; identical to SEQ ID NO: 174666
  derived and/or modified sequence opt4 from neuraminidase__InfluenzaA__AHM00761

SEQ ID NO: 177643 - RNA, 1410 nt, Artificial Sequence; identical to SEQ ID NO: 175895
  derived and/or modified sequence opt4 from neuraminidase__InfluenzaA__AHM00785

SEQ ID NO: 177644 - RNA, 1410 nt, Artificial Sequence; identical to SEQ ID NO: 175530
  derived and/or modified sequence opt4 from neuraminidase__InfluenzaA__AHM00797

SEQ ID NO: 177645 - RNA, 1410 nt, Artificial Sequence
  derived and/or modified sequence opt4 from neuraminidase__InfluenzaA__AHM00809
augaaccccaaccagaagaucaucaccaucggcagcgugagccugaccaucagcaccaucugcuucuucauccagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177646 - RNA, 1410 nt, Artificial Sequence; identical to SEQ ID NO: 177574
  derived and/or modified sequence opt4 from neuraminidase__InfluenzaA__AHM00821

SEQ ID NO: 177647 - RNA, 1410 nt, Artificial Sequence; identical to SEQ ID NO: 177574
  derived and/or modified sequence opt4 from neuraminidase__InfluenzaA__AHM00833

SEQ ID NO: 177648 - RNA, 1410 nt, Artificial Sequence; identical to SEQ ID NO: 175530
  derived and/or modified sequence opt4 from neuraminidase__InfluenzaA__AHM00845

SEQ ID NO: 177649 - RNA, 1410 nt, Artificial Sequence; identical to SEQ ID NO: 174666
  derived and/or modified sequence opt4 from neuraminidase__InfluenzaA__AHM00857

SEQ ID NO: 177650 - RNA, 1410 nt, Artificial Sequence; identical to SEQ ID NO: 174666
  derived and/or modified sequence opt4 from neuraminidase__InfluenzaA__AHM00869

SEQ ID NO: 177651 - RNA, 1410 nt, Artificial Sequence; identical to SEQ ID NO: 174666
  derived and/or modified sequence opt4 from neuraminidase__InfluenzaA__AHM00881

SEQ ID NO: 177652 - RNA, 1410 nt, Artificial Sequence; identical to SEQ ID NO: 175895
  derived and/or modified sequence opt4 from neuraminidase__InfluenzaA__AHM00893

SEQ ID NO: 177653 - RNA, 1410 nt, Artificial Sequence
  derived and/or modified sequence opt4 from neuraminidase__InfluenzaA__AHM00905
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177654 - RNA, 1410 nt, Artificial Sequence
  derived and/or modified sequence opt4 from neuraminidase__InfluenzaA__AHM00917
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacaucuggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177655 - RNA, 1410 nt, Artificial Sequence; identical to SEQ ID NO: 174666
  derived and/or modified sequence opt4 from neuraminidase__InfluenzaA__AHM00929

SEQ ID NO: 177656 - RNA, 1410 nt, Artificial Sequence
  derived and/or modified sequence opt4 from neuraminidase__InfluenzaA__AHM00941
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccaucagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177657 - RNA, 1410 nt, Artificial Sequence
  derived and/or modified sequence opt4 from neuraminidase__InfluenzaA__AHM00953
augaaccccaaccagaagaucaucaccaucggcagcgugagccugaccaucagcaccaucugcuucuucaugcagaucgccauccugaucaccaccgugacccugcacuucaagcaguacgccuucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177658 - RNA, 1410 nt, Artificial Sequence; identical to SEQ ID NO: 175895
  derived and/or modified sequence opt4 from neuraminidase__InfluenzaA__AHM00965

SEQ ID NO: 177659 - RNA, 1410 nt, Artificial Sequence; identical to SEQ ID NO: 175895
  derived and/or modified sequence opt4 from neuraminidase__InfluenzaA__AHM00977

SEQ ID NO: 177660 - RNA, 1398 nt, Artificial Sequence
  derived and/or modified sequence opt4 from neuraminidase__InfluenzaA__AHM24226
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagaugcugaagugggagagccugaccggcaccgccaagcacaacgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 177661 - RNA, 1398 nt, Artificial Sequence; identical to SEQ ID NO: 175974
  derived and/or modified sequence opt4 from neuraminidase__InfluenzaA__AHM24238

SEQ ID NO: 177662 - RNA, 1398 nt, Artificial Sequence
  derived and/or modified sequence opt4 from neuraminidase__InfluenzaA__AHM24250
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagaacagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 177663 - RNA, 1410 nt, Artificial Sequence; identical to SEQ ID NO: 173229
  derived and/or modified sequence opt4 from neuraminidase__InfluenzaA__AHM98312

SEQ ID NO: 177664 - RNA, 1410 nt, Artificial Sequence
  derived and/or modified sequence opt4 from neuraminidase__InfluenzaA__AHM98331
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugcacagcgacaccgugggcuggagcuggcccgacggcgccgagcugcccuucaccaucgacaaguga

SEQ ID NO: 177665 - RNA, 1410 nt, Artificial Sequence; identical to SEQ ID NO: 173245
  derived and/or modified sequence opt4 from neuraminidase__InfluenzaA__AHM98342

SEQ ID NO: 177666 - RNA, 1410 nt, Artificial Sequence
  derived and/or modified sequence opt4 from neuraminidase__InfluenzaA__AHM98353
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcguggacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177667 - RNA, 1410 nt, Artificial Sequence
  derived and/or modified sequence opt4 from neuraminidase__InfluenzaA__AHM98364
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaaccuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177668 - RNA, 1410 nt, Artificial Sequence
  derived and/or modified sequence opt4 from neuraminidase__InfluenzaA__AHM98375
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuucagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177669 - RNA, 1410 nt, Artificial Sequence; identical to SEQ ID NO: 173229
  derived and/or modified sequence opt4 from neuraminidase__InfluenzaA__AHM98386

SEQ ID NO: 177670 - RNA, 1410 nt, Artificial Sequence
  derived and/or modified sequence opt4 from neuraminidase__InfluenzaA__AHM98408
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggaucaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177671 - RNA, 1410 nt, Artificial Sequence; identical to SEQ ID NO: 177670
  derived and/or modified sequence opt4 from neuraminidase__InfluenzaA__AHM98419

SEQ ID NO: 177672 - RNA, 1410 nt, Artificial Sequence
  derived and/or modified sequence opt4 from neuraminidase__InfluenzaA__AHM98430
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagaacgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177673 - RNA, 1410 nt, Artificial Sequence; identical to SEQ ID NO: 173477
  derived and/or modified sequence opt4 from neuraminidase__InfluenzaA__AHM98441

SEQ ID NO: 177674 - RNA, 1410 nt, Artificial Sequence
  derived and/or modified sequence opt4 from neuraminidase__InfluenzaA__AHM98452
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcgugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177675 - RNA, 1410 nt, Artificial Sequence; identical to SEQ ID NO: 173229
  derived and/or modified sequence opt4 from neuraminidase__InfluenzaA__AHM98474

SEQ ID NO: 177676 - RNA, 1410 nt, Artificial Sequence
  derived and/or modified sequence opt4 from neuraminidase__InfluenzaA__AHM98485
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggugggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177677 - RNA, 1410 nt, Artificial Sequence
  derived and/or modified sequence opt4 from neuraminidase__InfluenzaA__AHM98496
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaagaacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaagugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177678 - RNA, 1410 nt, Artificial Sequence; identical to SEQ ID NO: 173229
  derived and/or modified sequence opt4 from neuraminidase__InfluenzaA__AHM98507

SEQ ID NO: 177679 - RNA, 1410 nt, Artificial Sequence
  derived and/or modified sequence opt4 from neuraminidase__InfluenzaA__AHM98518
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggaucaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaugagcuucugcggcgugaacagcgacaccgugggcuggagcuggcccgacggcgccgagcugcccuucaccaucgacaaguga

SEQ ID NO: 177680 - RNA, 1410 nt, Artificial Sequence; identical to SEQ ID NO: 172777
  derived and/or modified sequence opt4 from neuraminidase__InfluenzaA__AHM98529

SEQ ID NO: 177681 - RNA, 1410 nt, Artificial Sequence; identical to SEQ ID NO: 173521
  derived and/or modified sequence opt4 from neuraminidase__InfluenzaA__AHM98540

SEQ ID NO: 177682 - RNA, 1410 nt, Artificial Sequence
  derived and/or modified sequence opt4 from neuraminidase__InfluenzaA__AHM98562
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaaggccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcuacaccgugggcuggagcuggcccgacggcgccgagcugcccuucaccaucgacaaguga

SEQ ID NO: 177683 - RNA, 1410 nt, Artificial Sequence; identical to SEQ ID NO: 177672
  derived and/or modified sequence opt4 from neuraminidase__InfluenzaA__AHM98573

SEQ ID NO: 177684 - RNA, 1410 nt, Artificial Sequence
  derived and/or modified sequence opt4 from neuraminidase__InfluenzaA__AHM98584
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggaucaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugagauacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177685 - RNA, 1410 nt, Artificial Sequence; identical to SEQ ID NO: 177672
  derived and/or modified sequence opt4 from neuraminidase__InfluenzaA__AHM98595

SEQ ID NO: 177686 - RNA, 1410 nt, Artificial Sequence; identical to SEQ ID NO: 173229
  derived and/or modified sequence opt4 from neuraminidase__InfluenzaA__AHM98606

SEQ ID NO: 177687 - RNA, 1410 nt, Artificial Sequence
  derived and/or modified sequence opt4 from neuraminidase__InfluenzaA__AHM98617
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccuggaucaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccugggcugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177688 - RNA, 1410 nt, Artificial Sequence; identical to SEQ ID NO: 177670
  derived and/or modified sequence opt4 from neuraminidase__InfluenzaA__AHM98628

SEQ ID NO: 177689 - RNA, 1410 nt, Artificial Sequence
  derived and/or modified sequence opt4 from neuraminidase__InfluenzaA__AHM98639
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaucuacgagaacaacaccuggaucaaccagaccuacgugaacaucagcaacaccaacuucgccgccgagcagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177690 - RNA, 1410 nt, Artificial Sequence; identical to SEQ ID NO: 173229
  derived and/or modified sequence opt4 from neuraminidase__InfluenzaA__AHM98650

SEQ ID NO: 177691 - RNA, 1410 nt, Artificial Sequence; identical to SEQ ID NO: 173229
  derived and/or modified sequence opt4 from neuraminidase__InfluenzaA__AHM98661

SEQ ID NO: 177692 - RNA, 1410 nt, Artificial Sequence
  derived and/or modified sequence opt4 from neuraminidase__InfluenzaA__AHM98672
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagaacgugaucaccuacgagaacaacaccugggugaaccagaccuacgugaacaucagcaacaccaacuucgccgccgagcagagcguggugcccgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177693 - RNA, 1410 nt, Artificial Sequence
  derived and/or modified sequence opt4 from neuraminidase__InfluenzaA__AHM98683
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgacgccggccagagcguggugagcgugagacuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcuucaacuggcugaccaucggcaucagcggccccgacaacggcgccguggccgugcugaaguacaacggcaucaucaccgacaccaucagaagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177694 - RNA, 1410 nt, Artificial Sequence; identical to SEQ ID NO: 173229
  derived and/or modified sequence opt4 from neuraminidase__InfluenzaA__AHM98693

SEQ ID NO: 177695 - RNA, 1410 nt, Artificial Sequence; identical to SEQ ID NO: 175678
  derived and/or modified sequence opt4 from neuraminidase__InfluenzaA__AHM98704

SEQ ID NO: 177696 - RNA, 1410 nt, Artificial Sequence; identical to SEQ ID NO: 175678
  derived and/or modified sequence opt4 from neuraminidase__InfluenzaA__AHM98715

SEQ ID NO: 177697 - RNA, 1410 nt, Artificial Sequence; identical to SEQ ID NO: 173229
  derived and/or modified sequence opt4 from neuraminidase__InfluenzaA__AHM98726

SEQ ID NO: 177698 - RNA, 1410 nt, Artificial Sequence
  derived and/or modified sequence opt4 from neuraminidase__InfluenzaA__AHM98737
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaacuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucgugagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacgacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177699 - RNA, 1410 nt, Artificial Sequence; identical to SEQ ID NO: 175678
  derived and/or modified sequence opt4 from neuraminidase__InfluenzaA__AHM98748

SEQ ID NO: 177700 - RNA, 1410 nt, Artificial Sequence; identical to SEQ ID NO: 175678
  derived and/or modified sequence opt4 from neuraminidase__InfluenzaA__AHM98759

SEQ ID NO: 177701 - RNA, 1410 nt, Artificial Sequence
  derived and/or modified sequence opt4 from neuraminidase__InfluenzaA__AHM98770
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgccaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177702 - RNA, 1410 nt, Artificial Sequence
  derived and/or modified sequence opt4 from neuraminidase__InfluenzaA__AHM98781
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccagcgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 177703 - RNA, 1410 nt, Artificial Sequence; identical to SEQ ID NO: 173229
  derived and/or modified sequence opt4 from neuraminidase__InfluenzaA__AHM98801

SEQ ID NO: 177704 - RNA, 1410 nt, Artificial Sequence; identical to SEQ ID NO: 172777
  derived and/or modified sequence opt4 from neuraminidase__InfluenzaA__AHM98812

SEQ ID NO: 177705 - RNA, 1410 nt, Artificial Sequence
  derived and/or modified sequence opt4 from neuraminidase__InfluenzaA__AHM98823
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacaucaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177706 - RNA, 1410 nt, Artificial Sequence
  derived and/or modified sequence opt4 from neuraminidase__InfluenzaA__AHM98839
augaaccccaaccagaagaucaucaccaucggcagcgugugcaugaccgugggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177707 - RNA, 1410 nt, Artificial Sequence; identical to SEQ ID NO: 172777
  derived and/or modified sequence opt4 from neuraminidase__InfluenzaA__AHM98850

SEQ ID NO: 177708 - RNA, 1410 nt, Artificial Sequence; identical to SEQ ID NO: 172777
  derived and/or modified sequence opt4 from neuraminidase__InfluenzaA__AHM98861

SEQ ID NO: 177709 - RNA, 1410 nt, Artificial Sequence
  derived and/or modified sequence opt4 from neuraminidase__InfluenzaA__AHM98901
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177710 - RNA, 1410 nt, Artificial Sequence; identical to SEQ ID NO: 176366
  derived and/or modified sequence opt4 from neuraminidase__InfluenzaA__AHM98912

SEQ ID NO: 177711 - RNA, 1410 nt, Artificial Sequence; identical to SEQ ID NO: 176366
  derived and/or modified sequence opt4 from neuraminidase__InfluenzaA__AHM98923

SEQ ID NO: 177712 - RNA, 1410 nt, Artificial Sequence; identical to SEQ ID NO: 176366
  derived and/or modified sequence opt4 from neuraminidase__InfluenzaA__AHM98935

SEQ ID NO: 177713 - RNA, 1410 nt, Artificial Sequence; identical to SEQ ID NO: 176366
  derived and/or modified sequence opt4 from neuraminidase__InfluenzaA__AHM98943

SEQ ID NO: 177714 - RNA, 1410 nt, Artificial Sequence; identical to SEQ ID NO: 176366
  derived and/or modified sequence opt4 from neuraminidase__InfluenzaA__AHM98954

SEQ ID NO: 177715 - RNA, 1410 nt, Artificial Sequence; identical to SEQ ID NO: 176366
  derived and/or modified sequence opt4 from neuraminidase__InfluenzaA__AHM98972

SEQ ID NO: 177716 - RNA, 1410 nt, Artificial Sequence; identical to SEQ ID NO: 176366
  derived and/or modified sequence opt4 from neuraminidase__InfluenzaA__AHM98978

SEQ ID NO: 177717 - RNA, 1410 nt, Artificial Sequence; identical to SEQ ID NO: 176366
  derived and/or modified sequence opt4 from neuraminidase__InfluenzaA__AHM98990

SEQ ID NO: 177718 - RNA, 1410 nt, Artificial Sequence; identical to SEQ ID NO: 176366
  derived and/or modified sequence opt4 from neuraminidase__InfluenzaA__AHM99000

SEQ ID NO: 177719 - RNA, 1410 nt, Artificial Sequence; identical to SEQ ID NO: 176366
  derived and/or modified sequence opt4 from neuraminidase__InfluenzaA__AHM99011

SEQ ID NO: 177720 - RNA, 1410 nt, Artificial Sequence; identical to SEQ ID NO: 176342
  derived and/or modified sequence opt4 from neuraminidase__InfluenzaA__AHM99022

SEQ ID NO: 177721 - RNA, 1410 nt, Artificial Sequence; identical to SEQ ID NO: 176342
  derived and/or modified sequence opt4 from neuraminidase__InfluenzaA__AHM99034

SEQ ID NO: 177722 - RNA, 1410 nt, Artificial Sequence; identical to SEQ ID NO: 176342
  derived and/or modified sequence opt4 from neuraminidase__InfluenzaA__AHM99046

SEQ ID NO: 177723 - RNA, 1410 nt, Artificial Sequence; identical to SEQ ID NO: 176342
  derived and/or modified sequence opt4 from neuraminidase__InfluenzaA__AHM99057

SEQ ID NO: 177724 - RNA, 1410 nt, Artificial Sequence; identical to SEQ ID NO: 176342
  derived and/or modified sequence opt4 from neuraminidase__InfluenzaA__AHM99068

SEQ ID NO: 177725 - RNA, 1410 nt, Artificial Sequence; identical to SEQ ID NO: 176366
  derived and/or modified sequence opt4 from neuraminidase__InfluenzaA__AHM99078

SEQ ID NO: 177726 - RNA, 1410 nt, Artificial Sequence
  derived and/or modified sequence opt4 from neuraminidase__InfluenzaA__AHN00720
augaacaccaaccagagaaucaucaccaucggcaccaucugccugaucgugggcaucaucagccugcugcugcagaucggcaacaucgugagccuguggaucagccacagcauccagaccgaggagaagagccaccccgaggugugcaaccagagcgugaucaccuacgagaacaacaccugggugaaccagaccuacaucaacaucagcaacaccaacaucgccgccggccagggcgugacccccaucauccuggccggcaacagcagccugugccccaucagcggcugggccaucuacagcaaggacaacagcaucagaaucggcagcaagggcgacaucuucgugaugagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaugaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcaucgagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcgugaacagcgagaccgccagcuggagcuggcccgacggcgccgaccugcccuucaccaucgacaaguga

SEQ ID NO: 177727 - RNA, 1410 nt, Artificial Sequence
  derived and/or modified sequence opt4 from neuraminidase__InfluenzaA__AHN00767
augaacaccaaccagagaaucaucaccaucggcaccaucugccugaucgugggcaucaucagccugcugcugcagaucggcaacaucgugagccuguggaucagccacagcauccagaccggcgagaagagccaccccgaggugugcaaccagagcgugaucaccuacgagaacaacaccugggugaaccagaccuacgugaacaucagcaacaccaacaucgccgccggccagggcgugacccccaucauccuggccggcaacagcagccugugccccaucagcggcugggccaucuacagcaaggacaacagcaucagaaucggcagcaagggcgacaucuucgugaugagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcaucgagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcgugaacagcgagaccgccagcuggagcuggcccgacggcgccgaccugcccuucaccaucgacaaguga

SEQ ID NO: 177728 - RNA, 1398 nt, Artificial Sequence
  derived and/or modified sequence opt4 from neuraminidase__InfluenzaA__AHN96324
augaaccccaaccagaagauccugugcaccagcgccaccgccaucaucaucggcgccaucgccgugcugaucggcaucgccaaccugggccugaacaucggccugcaccugaagcccagcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccguggugcagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 177729 - RNA, 1410 nt, Artificial Sequence; identical to SEQ ID NO: 173663
  derived and/or modified sequence opt4 from neuraminidase__InfluenzaA__AHN96448

SEQ ID NO: 177730 - RNA, 1410 nt, Artificial Sequence; identical to SEQ ID NO: 174666
  derived and/or modified sequence opt4 from neuraminidase__InfluenzaA__AHN96450

SEQ ID NO: 177731 - RNA, 1410 nt, Artificial Sequence
  derived and/or modified sequence opt4 from neuraminidase__InfluenzaA__AHN96451
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucauguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177732 - RNA, 1410 nt, Artificial Sequence
  derived and/or modified sequence opt4 from neuraminidase__InfluenzaA__AHN96453
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccuggacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177733 - RNA, 1410 nt, Artificial Sequence
  derived and/or modified sequence opt4 from neuraminidase__InfluenzaA__AHZ13526
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaugaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacaagcacagcaacgacaccauccacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcgacagagccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacggcagcagcagcagcuacugcagaaaccccaacaacgagaagggcaaccacggcgugaagggcugggccuucgacgacggcaacgacguguggaugggcagaaccaucggcgaggagcugagaagcggcuacgagaccuucaaggugaucggcggcuggagcacccccaacagcaagcugcagaucaacagacaggugaucguggacagcaacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 177734 - RNA, 1413 nt, Artificial Sequence; identical to SEQ ID NO: 172725
  derived and/or modified sequence opt4 from neuraminidase__InfluenzaA__AHZ13584

SEQ ID NO: 177735 - RNA, 1410 nt, Artificial Sequence; identical to SEQ ID NO: 175442
  derived and/or modified sequence opt4 from neuraminidase__InfluenzaA__AHZ35575

SEQ ID NO: 177736 - RNA, 1410 nt, Artificial Sequence; identical to SEQ ID NO: 175442
  derived and/or modified sequence opt4 from neuraminidase__InfluenzaA__AHZ35587

SEQ ID NO: 177737 - RNA, 1410 nt, Artificial Sequence
  derived and/or modified sequence opt4 from neuraminidase__InfluenzaA__AHZ35611
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcagaagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177738 - RNA, 1410 nt, Artificial Sequence; identical to SEQ ID NO: 175442
  derived and/or modified sequence opt4 from neuraminidase__InfluenzaA__AHZ35623

SEQ ID NO: 177739 - RNA, 1410 nt, Artificial Sequence; identical to SEQ ID NO: 175442
  derived and/or modified sequence opt4 from neuraminidase__InfluenzaA__AHZ35635

SEQ ID NO: 177740 - RNA, 1410 nt, Artificial Sequence
  derived and/or modified sequence opt4 from neuraminidase__InfluenzaA__AHZ35647
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccgacgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177741 - RNA, 1410 nt, Artificial Sequence; identical to SEQ ID NO: 175442
  derived and/or modified sequence opt4 from neuraminidase__InfluenzaA__AHZ35659

SEQ ID NO: 177742 - RNA, 1410 nt, Artificial Sequence; identical to SEQ ID NO: 175442
  derived and/or modified sequence opt4 from neuraminidase__InfluenzaA__AHZ35671

SEQ ID NO: 177743 - RNA, 1410 nt, Artificial Sequence; identical to SEQ ID NO: 175442
  derived and/or modified sequence opt4 from neuraminidase__InfluenzaA__AHZ35683

SEQ ID NO: 177744 - RNA, 1410 nt, Artificial Sequence
  derived and/or modified sequence opt4 from neuraminidase__InfluenzaA__AHZ35695
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacgagagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaacagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177745 - RNA, 1410 nt, Artificial Sequence
  derived and/or modified sequence opt4 from neuraminidase__InfluenzaA__AHZ35719
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugacccccaucuga

SEQ ID NO: 177746 - RNA, 1410 nt, Artificial Sequence; identical to SEQ ID NO: 175442
  derived and/or modified sequence opt4 from neuraminidase__InfluenzaA__AHZ35731

SEQ ID NO: 177747 - RNA, 1410 nt, Artificial Sequence; identical to SEQ ID NO: 175442
  derived and/or modified sequence opt4 from neuraminidase__InfluenzaA__AHZ35743

SEQ ID NO: 177748 - RNA, 1410 nt, Artificial Sequence; identical to SEQ ID NO: 175442
  derived and/or modified sequence opt4 from neuraminidase__InfluenzaA__AHZ35755

SEQ ID NO: 177749 - RNA, 1410 nt, Artificial Sequence; identical to SEQ ID NO: 175442
  derived and/or modified sequence opt4 from neuraminidase__InfluenzaA__AHZ35767

SEQ ID NO: 177750 - RNA, 1410 nt, Artificial Sequence; identical to SEQ ID NO: 175442
  derived and/or modified sequence opt4 from neuraminidase__InfluenzaA__AHZ35779

SEQ ID NO: 177751 - RNA, 1410 nt, Artificial Sequence
  derived and/or modified sequence opt4 from neuraminidase__InfluenzaA__AHZ35803
augaaccccaaccagaagaucaucaccaucggcagcgugugcaugaccaucggcauggccaaccugaugcugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177752 - RNA, 1410 nt, Artificial Sequence
  derived and/or modified sequence opt4 from neuraminidase__InfluenzaA__AHZ35814
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgaccugugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177753 - RNA, 1410 nt, Artificial Sequence
  derived and/or modified sequence opt4 from neuraminidase__InfluenzaA__AHZ35837
augaaccccaaccagaagaucaucaccaucggcagcgugugcaugaccaucggcauggccaaccugaugcugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177754 - RNA, 1410 nt, Artificial Sequence; identical to SEQ ID NO: 177753
  derived and/or modified sequence opt4 from neuraminidase__InfluenzaA__AHZ35848

SEQ ID NO: 177755 - RNA, 1410 nt, Artificial Sequence; identical to SEQ ID NO: 177753
  derived and/or modified sequence opt4 from neuraminidase__InfluenzaA__AHZ35859

SEQ ID NO: 177756 - RNA, 1410 nt, Artificial Sequence; identical to SEQ ID NO: 177752
  derived and/or modified sequence opt4 from neuraminidase__InfluenzaA__AHZ35870

SEQ ID NO: 177757 - RNA, 1410 nt, Artificial Sequence; identical to SEQ ID NO: 177752
  derived and/or modified sequence opt4 from neuraminidase__InfluenzaA__AHZ35882

SEQ ID NO: 177758 - RNA, 1410 nt, Artificial Sequence
  derived and/or modified sequence opt4 from neuraminidase__InfluenzaA__AHZ35894
augaaccccaaccagaagaucaucaccaucggcagcgugugcaugaccaucggcauggccaaccugaugcugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcagcggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177759 - RNA, 1410 nt, Artificial Sequence; identical to SEQ ID NO: 177753
  derived and/or modified sequence opt4 from neuraminidase__InfluenzaA__AHZ35905

SEQ ID NO: 177760 - RNA, 1410 nt, Artificial Sequence; identical to SEQ ID NO: 177753
  derived and/or modified sequence opt4 from neuraminidase__InfluenzaA__AHZ35916

SEQ ID NO: 177761 - RNA, 1410 nt, Artificial Sequence; identical to SEQ ID NO: 173478
  derived and/or modified sequence opt4 from neuraminidase__InfluenzaA__AHZ35927

SEQ ID NO: 177762 - RNA, 1410 nt, Artificial Sequence
  derived and/or modified sequence opt4 from neuraminidase__InfluenzaA__AHZ35938
augaaccccaaccagaagaucaucaccaucggcagcgugugcaugaucaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177763 - RNA, 1410 nt, Artificial Sequence; identical to SEQ ID NO: 177752
  derived and/or modified sequence opt4 from neuraminidase__InfluenzaA__AHZ35949

SEQ ID NO: 177764 - RNA, 1410 nt, Artificial Sequence
  derived and/or modified sequence opt4 from neuraminidase__InfluenzaA__AHZ35961
augaaccccaaccagaagaucaucaccaucggcagcgugugcaugaccaucggcauggccaaccugaugcugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 177765 - RNA, 1410 nt, Artificial Sequence; identical to SEQ ID NO: 177753
  derived and/or modified sequence opt4 from neuraminidase__InfluenzaA__AHZ35972

SEQ ID NO: 177766 - RNA, 1410 nt, Artificial Sequence
  derived and/or modified sequence opt4 from neuraminidase__InfluenzaA__AHZ35983
augaaccccaaccagaagaucaccaccaucggcagcgugugcaugaccaucggcauggccaaccugaugcugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177767 - RNA, 1410 nt, Artificial Sequence; identical to SEQ ID NO: 177753
  derived and/or modified sequence opt4 from neuraminidase__InfluenzaA__AHZ35994

SEQ ID NO: 177768 - RNA, 1410 nt, Artificial Sequence; identical to SEQ ID NO: 177753
  derived and/or modified sequence opt4 from neuraminidase__InfluenzaA__AHZ36005

SEQ ID NO: 177769 - RNA, 1410 nt, Artificial Sequence; identical to SEQ ID NO: 177753
  derived and/or modified sequence opt4 from neuraminidase__InfluenzaA__AHZ36016

SEQ ID NO: 177770 - RNA, 1410 nt, Artificial Sequence
  derived and/or modified sequence opt4 from neuraminidase__InfluenzaA__AHZ36027
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaucuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcuucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177771 - RNA, 1410 nt, Artificial Sequence
  derived and/or modified sequence opt4 from neuraminidase__InfluenzaA__AHZ36050
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaagaaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177772 - RNA, 1410 nt, Artificial Sequence
  derived and/or modified sequence opt4 from neuraminidase__InfluenzaA__AHZ36062
augaaccccaaccagaagaucaucaccaucggcagcgugugcaugaccaucggcauggccaaccugaugcugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccugggcugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177773 - RNA, 1410 nt, Artificial Sequence; identical to SEQ ID NO: 177753
  derived and/or modified sequence opt4 from neuraminidase__InfluenzaA__AHZ36084

SEQ ID NO: 177774 - RNA, 1410 nt, Artificial Sequence
  derived and/or modified sequence opt4 from neuraminidase__InfluenzaA__AHZ36095
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaucuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcuucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcggcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177775 - RNA, 1410 nt, Artificial Sequence; identical to SEQ ID NO: 177753
  derived and/or modified sequence opt4 from neuraminidase__InfluenzaA__AHZ36106

SEQ ID NO: 177776 - RNA, 1410 nt, Artificial Sequence
  derived and/or modified sequence opt4 from neuraminidase__InfluenzaA__AHZ36117
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaucuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugcagcaucggcgaggugcccagccccuacaacagcagauucgagagcguggccuggagcgccagcgccugccacgacggcuucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177777 - RNA, 1410 nt, Artificial Sequence; identical to SEQ ID NO: 177753
  derived and/or modified sequence opt4 from neuraminidase__InfluenzaA__AHZ36128

SEQ ID NO: 177778 - RNA, 1410 nt, Artificial Sequence; identical to SEQ ID NO: 177753
  derived and/or modified sequence opt4 from neuraminidase__InfluenzaA__AHZ36139

SEQ ID NO: 177779 - RNA, 1410 nt, Artificial Sequence; identical to SEQ ID NO: 177771
  derived and/or modified sequence opt4 from neuraminidase__InfluenzaA__AHZ36150

SEQ ID NO: 177780 - RNA, 1410 nt, Artificial Sequence; identical to SEQ ID NO: 177753
  derived and/or modified sequence opt4 from neuraminidase__InfluenzaA__AHZ36161

SEQ ID NO: 177781 - RNA, 1410 nt, Artificial Sequence; identical to SEQ ID NO: 177753
  derived and/or modified sequence opt4 from neuraminidase__InfluenzaA__AHZ36172

SEQ ID NO: 177782 - RNA, 1410 nt, Artificial Sequence
  derived and/or modified sequence opt4 from neuraminidase__InfluenzaA__AHZ36183
augaaccccaaccagaagaucaucaccaucggcagcgugugcaugaccaucggcauggccaaccugaugcugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcauccugggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177783 - RNA, 1410 nt, Artificial Sequence; identical to SEQ ID NO: 177752
  derived and/or modified sequence opt4 from neuraminidase__InfluenzaA__AHZ36194

SEQ ID NO: 177784 - RNA, 1410 nt, Artificial Sequence; identical to SEQ ID NO: 177771
  derived and/or modified sequence opt4 from neuraminidase__InfluenzaA__AHZ36206

SEQ ID NO: 177785 - RNA, 1410 nt, Artificial Sequence; identical to SEQ ID NO: 177753
  derived and/or modified sequence opt4 from neuraminidase__InfluenzaA__AHZ36218

SEQ ID NO: 177786 - RNA, 1410 nt, Artificial Sequence; identical to SEQ ID NO: 177771
  derived and/or modified sequence opt4 from neuraminidase__InfluenzaA__AHZ36229

SEQ ID NO: 177787 - RNA, 1410 nt, Artificial Sequence; identical to SEQ ID NO: 177753
  derived and/or modified sequence opt4 from neuraminidase__InfluenzaA__AHZ36241

SEQ ID NO: 177788 - RNA, 1410 nt, Artificial Sequence; identical to SEQ ID NO: 177753
  derived and/or modified sequence opt4 from neuraminidase__InfluenzaA__AHZ36252

SEQ ID NO: 177789 - RNA, 1410 nt, Artificial Sequence; identical to SEQ ID NO: 177753
  derived and/or modified sequence opt4 from neuraminidase__InfluenzaA__AHZ36263

SEQ ID NO: 177790 - RNA, 1410 nt, Artificial Sequence; identical to SEQ ID NO: 175442
  derived and/or modified sequence opt4 from neuraminidase__InfluenzaA__AHZ36274

SEQ ID NO: 177791 - RNA, 1410 nt, Artificial Sequence; identical to SEQ ID NO: 177753
  derived and/or modified sequence opt4 from neuraminidase__InfluenzaA__AHZ36286

SEQ ID NO: 177792 - RNA, 1410 nt, Artificial Sequence
  derived and/or modified sequence opt4 from neuraminidase__InfluenzaA__AHZ36297
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccagacccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcggcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177793 - RNA, 1410 nt, Artificial Sequence
  derived and/or modified sequence opt4 from neuraminidase__InfluenzaA__AHZ36309
augaaccccaaccagaagaucaucaccaucggcagcgugugcaugaccaucggcauggccaaccugaugcugcagaucggcaacaucaucagcaucuggaucagccacagcauccagcugggcgacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177794 - RNA, 1410 nt, Artificial Sequence; identical to SEQ ID NO: 177753
  derived and/or modified sequence opt4 from neuraminidase__InfluenzaA__AHZ36320

SEQ ID NO: 177795 - RNA, 1410 nt, Artificial Sequence; identical to SEQ ID NO: 177753
  derived and/or modified sequence opt4 from neuraminidase__InfluenzaA__AHZ36331

SEQ ID NO: 177796 - RNA, 1410 nt, Artificial Sequence; identical to SEQ ID NO: 175442
  derived and/or modified sequence opt4 from neuraminidase__InfluenzaA__AHZ36353

SEQ ID NO: 177797 - RNA, 1410 nt, Artificial Sequence
  derived and/or modified sequence opt4 from neuraminidase__InfluenzaA__AHZ36365
augaaccccaaccagaagaucaucaccaucggcagcgugugcaugaccaucggcauggccaaccugaugcugcagaucggcaacaucaucagcaucuggaucagccaccccauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177798 - RNA, 1410 nt, Artificial Sequence; identical to SEQ ID NO: 175442
  derived and/or modified sequence opt4 from neuraminidase__InfluenzaA__AHZ36376

SEQ ID NO: 177799 - RNA, 1410 nt, Artificial Sequence; identical to SEQ ID NO: 175442
  derived and/or modified sequence opt4 from neuraminidase__InfluenzaA__AHZ36388

SEQ ID NO: 177800 - RNA, 1410 nt, Artificial Sequence; identical to SEQ ID NO: 175442
  derived and/or modified sequence opt4 from neuraminidase__InfluenzaA__AHZ36400

SEQ ID NO: 177801 - RNA, 1410 nt, Artificial Sequence; identical to SEQ ID NO: 175442
  derived and/or modified sequence opt4 from neuraminidase__InfluenzaA__AHZ36412

SEQ ID NO: 177802 - RNA, 1410 nt, Artificial Sequence; identical to SEQ ID NO: 175442
  derived and/or modified sequence opt4 from neuraminidase__InfluenzaA__AHZ36424

SEQ ID NO: 177803 - RNA, 1410 nt, Artificial Sequence; identical to SEQ ID NO: 175442
  derived and/or modified sequence opt4 from neuraminidase__InfluenzaA__AHZ36436

SEQ ID NO: 177804 - RNA, 1410 nt, Artificial Sequence
  derived and/or modified sequence opt4 from neuraminidase__InfluenzaA__AHZ36448
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagaagaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177805 - RNA, 1410 nt, Artificial Sequence; identical to SEQ ID NO: 175442
  derived and/or modified sequence opt4 from neuraminidase__InfluenzaA__AHZ36460

SEQ ID NO: 177806 - RNA, 1410 nt, Artificial Sequence; identical to SEQ ID NO: 175442
  derived and/or modified sequence opt4 from neuraminidase__InfluenzaA__AHZ36472

SEQ ID NO: 177807 - RNA, 1410 nt, Artificial Sequence; identical to SEQ ID NO: 175442
  derived and/or modified sequence opt4 from neuraminidase__InfluenzaA__AHZ36484

SEQ ID NO: 177808 - RNA, 1410 nt, Artificial Sequence; identical to SEQ ID NO: 175442
  derived and/or modified sequence opt4 from neuraminidase__InfluenzaA__AHZ36496

SEQ ID NO: 177809 - RNA, 1410 nt, Artificial Sequence; identical to SEQ ID NO: 175442
  derived and/or modified sequence opt4 from neuraminidase__InfluenzaA__AHZ36508

SEQ ID NO: 177810 - RNA, 1410 nt, Artificial Sequence; identical to SEQ ID NO: 175442
  derived and/or modified sequence opt4 from neuraminidase__InfluenzaA__AHZ36520

SEQ ID NO: 177811 - RNA, 1410 nt, Artificial Sequence
  derived and/or modified sequence opt4 from neuraminidase__InfluenzaA__AHZ36532
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaccuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177812 - RNA, 1410 nt, Artificial Sequence; identical to SEQ ID NO: 175442
  derived and/or modified sequence opt4 from neuraminidase__InfluenzaA__AHZ36544

SEQ ID NO: 177813 - RNA, 1410 nt, Artificial Sequence; identical to SEQ ID NO: 175442
  derived and/or modified sequence opt4 from neuraminidase__InfluenzaA__AHZ36556

SEQ ID NO: 177814 - RNA, 1410 nt, Artificial Sequence; identical to SEQ ID NO: 175442
  derived and/or modified sequence opt4 from neuraminidase__InfluenzaA__AHZ36568

SEQ ID NO: 177815 - RNA, 1410 nt, Artificial Sequence; identical to SEQ ID NO: 175442
  derived and/or modified sequence opt4 from neuraminidase__InfluenzaA__AHZ36580

SEQ ID NO: 177816 - RNA, 1410 nt, Artificial Sequence; identical to SEQ ID NO: 175442
  derived and/or modified sequence opt4 from neuraminidase__InfluenzaA__AHZ36592

SEQ ID NO: 177817 - RNA, 1410 nt, Artificial Sequence; identical to SEQ ID NO: 175442
  derived and/or modified sequence opt4 from neuraminidase__InfluenzaA__AHZ36604

SEQ ID NO: 177818 - RNA, 1410 nt, Artificial Sequence; identical to SEQ ID NO: 175442
  derived and/or modified sequence opt4 from neuraminidase__InfluenzaA__AHZ36616

SEQ ID NO: 177819 - RNA, 1410 nt, Artificial Sequence
  derived and/or modified sequence opt4 from neuraminidase__InfluenzaA__AHZ36628
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177820 - RNA, 1410 nt, Artificial Sequence
  derived and/or modified sequence opt4 from neuraminidase__InfluenzaA__AHZ36640
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177821 - RNA, 1410 nt, Artificial Sequence; identical to SEQ ID NO: 175442
  derived and/or modified sequence opt4 from neuraminidase__InfluenzaA__AHZ36652

SEQ ID NO: 177822 - RNA, 1410 nt, Artificial Sequence; identical to SEQ ID NO: 174666
  derived and/or modified sequence opt4 from neuraminidase__InfluenzaA__AHZ36664

SEQ ID NO: 177823 - RNA, 1410 nt, Artificial Sequence; identical to SEQ ID NO: 174666
  derived and/or modified sequence opt4 from neuraminidase__InfluenzaA__AHZ36676

SEQ ID NO: 177824 - RNA, 1410 nt, Artificial Sequence; identical to SEQ ID NO: 174666
  derived and/or modified sequence opt4 from neuraminidase__InfluenzaA__AHZ36688

SEQ ID NO: 177825 - RNA, 1398 nt, Artificial Sequence; identical to SEQ ID NO: 175974
  derived and/or modified sequence opt4 from neuraminidase__InfluenzaA__AHZ39689

SEQ ID NO: 177826 - RNA, 1398 nt, Artificial Sequence; identical to SEQ ID NO: 175974
  derived and/or modified sequence opt4 from neuraminidase__InfluenzaA__AHZ39713

SEQ ID NO: 177827 - RNA, 1398 nt, Artificial Sequence; identical to SEQ ID NO: 175974
  derived and/or modified sequence opt4 from neuraminidase__InfluenzaA__AHZ39725

SEQ ID NO: 177828 - RNA, 1398 nt, Artificial Sequence; identical to SEQ ID NO: 175974
  derived and/or modified sequence opt4 from neuraminidase__InfluenzaA__AHZ39737

SEQ ID NO: 177829 - RNA, 1398 nt, Artificial Sequence
  derived and/or modified sequence opt4 from neuraminidase__InfluenzaA__AHZ39749
augaaccccaaccagaagauccugugcaucagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 177830 - RNA, 1398 nt, Artificial Sequence; identical to SEQ ID NO: 177829
  derived and/or modified sequence opt4 from neuraminidase__InfluenzaA__AHZ39761

SEQ ID NO: 177831 - RNA, 1398 nt, Artificial Sequence; identical to SEQ ID NO: 175974
  derived and/or modified sequence opt4 from neuraminidase__InfluenzaA__AHZ39773

SEQ ID NO: 177832 - RNA, 1398 nt, Artificial Sequence; identical to SEQ ID NO: 175974
  derived and/or modified sequence opt4 from neuraminidase__InfluenzaA__AHZ39785

SEQ ID NO: 177833 - RNA, 1410 nt, Artificial Sequence
  derived and/or modified sequence opt4 from neuraminidase__InfluenzaA__AHZ39797
augaaccccaaccagaagaucaucaccaucggcagcgugagccugaccaucagcaccgugugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaagagcgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177834 - RNA, 1410 nt, Artificial Sequence
  derived and/or modified sequence opt4 from neuraminidase__InfluenzaA__AHZ39821
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaagaaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaccuga

SEQ ID NO: 177835 - RNA, 1410 nt, Artificial Sequence; identical to SEQ ID NO: 175909
  derived and/or modified sequence opt4 from neuraminidase__InfluenzaA__AHZ39833

SEQ ID NO: 177836 - RNA, 1410 nt, Artificial Sequence; identical to SEQ ID NO: 174666
  derived and/or modified sequence opt4 from neuraminidase__InfluenzaA__AHZ39844

SEQ ID NO: 177837 - RNA, 1410 nt, Artificial Sequence
  derived and/or modified sequence opt4 from neuraminidase__InfluenzaA__AHZ39856
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcccaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177838 - RNA, 1410 nt, Artificial Sequence; identical to SEQ ID NO: 174666
  derived and/or modified sequence opt4 from neuraminidase__InfluenzaA__AHZ39868

SEQ ID NO: 177839 - RNA, 1410 nt, Artificial Sequence
  derived and/or modified sequence opt4 from neuraminidase__InfluenzaA__AHZ39892
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177840 - RNA, 1410 nt, Artificial Sequence; identical to SEQ ID NO: 175874
  derived and/or modified sequence opt4 from neuraminidase__InfluenzaA__AHZ39904

SEQ ID NO: 177841 - RNA, 1410 nt, Artificial Sequence; identical to SEQ ID NO: 175874
  derived and/or modified sequence opt4 from neuraminidase__InfluenzaA__AHZ39916

SEQ ID NO: 177842 - RNA, 1410 nt, Artificial Sequence; identical to SEQ ID NO: 174666
  derived and/or modified sequence opt4 from neuraminidase__InfluenzaA__AHZ39928

SEQ ID NO: 177843 - RNA, 1410 nt, Artificial Sequence
  derived and/or modified sequence opt4 from neuraminidase__InfluenzaA__AHZ39940
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177844 - RNA, 1410 nt, Artificial Sequence; identical to SEQ ID NO: 174666
  derived and/or modified sequence opt4 from neuraminidase__InfluenzaA__AHZ39952

SEQ ID NO: 177845 - RNA, 1410 nt, Artificial Sequence; identical to SEQ ID NO: 174666
  derived and/or modified sequence opt4 from neuraminidase__InfluenzaA__AHZ39976

SEQ ID NO: 177846 - RNA, 1410 nt, Artificial Sequence
  derived and/or modified sequence opt4 from neuraminidase__InfluenzaA__AHZ39988
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcacccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177847 - RNA, 1410 nt, Artificial Sequence; identical to SEQ ID NO: 174666
  derived and/or modified sequence opt4 from neuraminidase__InfluenzaA__AHZ40000

SEQ ID NO: 177848 - RNA, 1410 nt, Artificial Sequence; identical to SEQ ID NO: 174666
  derived and/or modified sequence opt4 from neuraminidase__InfluenzaA__AHZ40012

SEQ ID NO: 177849 - RNA, 1410 nt, Artificial Sequence
  derived and/or modified sequence opt4 from neuraminidase__InfluenzaA__AHZ40024
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuucgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177850 - RNA, 1410 nt, Artificial Sequence; identical to SEQ ID NO: 174666
  derived and/or modified sequence opt4 from neuraminidase__InfluenzaA__AHZ40036

SEQ ID NO: 177851 - RNA, 1410 nt, Artificial Sequence; identical to SEQ ID NO: 175877
  derived and/or modified sequence opt4 from neuraminidase__InfluenzaA__AHZ40048

SEQ ID NO: 177852 - RNA, 1410 nt, Artificial Sequence; identical to SEQ ID NO: 174666
  derived and/or modified sequence opt4 from neuraminidase__InfluenzaA__AHZ40063

SEQ ID NO: 177853 - RNA, 1410 nt, Artificial Sequence
  derived and/or modified sequence opt4 from neuraminidase__InfluenzaA__AHZ40075
augaaccccaaccagaagaucaucaccaucggcagcgugagccugaccaucagcaccgugugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaacagcaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177854 - RNA, 1410 nt, Artificial Sequence; identical to SEQ ID NO: 174666
  derived and/or modified sequence opt4 from neuraminidase__InfluenzaA__AHZ40087

SEQ ID NO: 177855 - RNA, 1410 nt, Artificial Sequence; identical to SEQ ID NO: 175877
  derived and/or modified sequence opt4 from neuraminidase__InfluenzaA__AHZ40099

SEQ ID NO: 177856 - RNA, 1410 nt, Artificial Sequence
  derived and/or modified sequence opt4 from neuraminidase__InfluenzaA__AHZ40111
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177857 - RNA, 1410 nt, Artificial Sequence
  derived and/or modified sequence opt4 from neuraminidase__InfluenzaA__AHZ40123
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaccgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagaacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177858 - RNA, 1410 nt, Artificial Sequence; identical to SEQ ID NO: 174666
  derived and/or modified sequence opt4 from neuraminidase__InfluenzaA__AHZ40133

SEQ ID NO: 177859 - RNA, 1410 nt, Artificial Sequence; identical to SEQ ID NO: 175884
  derived and/or modified sequence opt4 from neuraminidase__InfluenzaA__AHZ40145

SEQ ID NO: 177860 - RNA, 1410 nt, Artificial Sequence
  derived and/or modified sequence opt4 from neuraminidase__InfluenzaA__AHZ40157
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagcugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgccgugcuguggaccagcaacagcaucgugguguucugcggcaccagcggcaccuacggcaccggcagcuggcccgacggcgccgaccugaaccugaugcccaucuga

SEQ ID NO: 177861 - RNA, 1410 nt, Artificial Sequence
  derived and/or modified sequence opt4 from neuraminidase__InfluenzaA__AHZ40169
augaaccccaaccagaagaucaucaccaucggcagcgugugcaugaccaucggcauggccaaccugauccugcagaucggcaacaucaucagcaucuggaucagccacagcauccagcuggagaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177862 - RNA, 1410 nt, Artificial Sequence
  derived and/or modified sequence opt4 from neuraminidase__InfluenzaA__AHZ40180
augaaccccaaccagaagaucaucaccaucggcagcgugagccugaccaucagcaccaucugcuucuucaugcagaucaccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177863 - RNA, 1410 nt, Artificial Sequence; identical to SEQ ID NO: 175530
  derived and/or modified sequence opt4 from neuraminidase__InfluenzaA__AHZ40192

SEQ ID NO: 177864 - RNA, 1410 nt, Artificial Sequence; identical to SEQ ID NO: 174666
  derived and/or modified sequence opt4 from neuraminidase__InfluenzaA__AHZ40204

SEQ ID NO: 177865 - RNA, 1410 nt, Artificial Sequence; identical to SEQ ID NO: 174666
  derived and/or modified sequence opt4 from neuraminidase__InfluenzaA__AHZ40216

SEQ ID NO: 177866 - RNA, 1410 nt, Artificial Sequence; identical to SEQ ID NO: 175895
  derived and/or modified sequence opt4 from neuraminidase__InfluenzaA__AHZ40228

SEQ ID NO: 177867 - RNA, 1410 nt, Artificial Sequence
  derived and/or modified sequence opt4 from neuraminidase__InfluenzaA__AHZ40240
augaaccccaaccagaagaucaucaccaucggcagcgugagccugaccaucagcaccaucugcuuccugaugcagaucgccauccugaucaccaccgccacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacagaagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177868 - RNA, 1410 nt, Artificial Sequence
  derived and/or modified sequence opt4 from neuraminidase__InfluenzaA__AHZ40252
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgaggacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177869 - RNA, 1410 nt, Artificial Sequence; identical to SEQ ID NO: 177614
  derived and/or modified sequence opt4 from neuraminidase__InfluenzaA__AHZ40264

SEQ ID NO: 177870 - RNA, 1410 nt, Artificial Sequence; identical to SEQ ID NO: 174666
  derived and/or modified sequence opt4 from neuraminidase__InfluenzaA__AHZ40276

SEQ ID NO: 177871 - RNA, 1410 nt, Artificial Sequence
  derived and/or modified sequence opt4 from neuraminidase__InfluenzaA__AHZ40288
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcgugaucagcuggagcaaggacauccugagaacccaggagagcgagugcgugugcaucaacggcaccugcgccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177872 - RNA, 1410 nt, Artificial Sequence
  derived and/or modified sequence opt4 from neuraminidase__InfluenzaA__AHZ40312
augaaccccaaccagaagaucaucaccaucggcagcgugagccugaccaucagcaccaucugcuucuucaugcagaucgccauccugaucaccaccgugacccugcacuucaagcaguacgaguucaacuacccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcguggugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177873 - RNA, 1410 nt, Artificial Sequence; identical to SEQ ID NO: 174666
  derived and/or modified sequence opt4 from neuraminidase__InfluenzaA__AHZ40324

SEQ ID NO: 177874 - RNA, 1410 nt, Artificial Sequence; identical to SEQ ID NO: 174666
  derived and/or modified sequence opt4 from neuraminidase__InfluenzaA__AHZ40336

SEQ ID NO: 177875 - RNA, 1410 nt, Artificial Sequence; identical to SEQ ID NO: 177849
  derived and/or modified sequence opt4 from neuraminidase__InfluenzaA__AHZ40348

SEQ ID NO: 177876 - RNA, 1410 nt, Artificial Sequence; identical to SEQ ID NO: 175874
  derived and/or modified sequence opt4 from neuraminidase__InfluenzaA__AHZ40360

SEQ ID NO: 177877 - RNA, 1410 nt, Artificial Sequence
  derived and/or modified sequence opt4 from neuraminidase__InfluenzaA__AHZ40372
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177878 - RNA, 1410 nt, Artificial Sequence; identical to SEQ ID NO: 175530
  derived and/or modified sequence opt4 from neuraminidase__InfluenzaA__AHZ40384

SEQ ID NO: 177879 - RNA, 1410 nt, Artificial Sequence; identical to SEQ ID NO: 174666
  derived and/or modified sequence opt4 from neuraminidase__InfluenzaA__AHZ40396

SEQ ID NO: 177880 - RNA, 1410 nt, Artificial Sequence; identical to SEQ ID NO: 174666
  derived and/or modified sequence opt4 from neuraminidase__InfluenzaA__AHZ40408

SEQ ID NO: 177881 - RNA, 1410 nt, Artificial Sequence; identical to SEQ ID NO: 174666
  derived and/or modified sequence opt4 from neuraminidase__InfluenzaA__AHZ40420

SEQ ID NO: 177882 - RNA, 1410 nt, Artificial Sequence
  derived and/or modified sequence opt4 from neuraminidase__InfluenzaA__AHZ40432
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucaucgacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177883 - RNA, 1410 nt, Artificial Sequence; identical to SEQ ID NO: 174666
  derived and/or modified sequence opt4 from neuraminidase__InfluenzaA__AHZ40444

SEQ ID NO: 177884 - RNA, 1410 nt, Artificial Sequence
  derived and/or modified sequence opt4 from neuraminidase__InfluenzaA__AHZ40456
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacaugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177885 - RNA, 1410 nt, Artificial Sequence
  derived and/or modified sequence opt4 from neuraminidase__InfluenzaA__AHZ40468
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcaacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177886 - RNA, 1410 nt, Artificial Sequence; identical to SEQ ID NO: 175874
  derived and/or modified sequence opt4 from neuraminidase__InfluenzaA__AHZ40480

SEQ ID NO: 177887 - RNA, 1410 nt, Artificial Sequence; identical to SEQ ID NO: 177312
  derived and/or modified sequence opt4 from neuraminidase__InfluenzaA__AHZ40492

SEQ ID NO: 177888 - RNA, 1410 nt, Artificial Sequence; identical to SEQ ID NO: 174666
  derived and/or modified sequence opt4 from neuraminidase__InfluenzaA__AHZ40503

SEQ ID NO: 177889 - RNA, 1410 nt, Artificial Sequence; identical to SEQ ID NO: 174666
  derived and/or modified sequence opt4 from neuraminidase__InfluenzaA__AHZ40515

SEQ ID NO: 177890 - RNA, 1410 nt, Artificial Sequence
  derived and/or modified sequence opt4 from neuraminidase__InfluenzaA__AHZ40527
augaaccccaaccagaagaucaucaccaucggcagcgugagccugaccaucagcaccaugugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177891 - RNA, 1410 nt, Artificial Sequence
  derived and/or modified sequence opt4 from neuraminidase__InfluenzaA__AHZ40539
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugaacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177892 - RNA, 1410 nt, Artificial Sequence; identical to SEQ ID NO: 174666
  derived and/or modified sequence opt4 from neuraminidase__InfluenzaA__AHZ40551

SEQ ID NO: 177893 - RNA, 1410 nt, Artificial Sequence
  derived and/or modified sequence opt4 from neuraminidase__InfluenzaA__AHZ40563
augaaccccaaccagaagaucaucaccaucggcagcgugagccugaccaucagcaccgugugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaacagcaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177894 - RNA, 1410 nt, Artificial Sequence
  derived and/or modified sequence opt4 from neuraminidase__InfluenzaA__AHZ40575
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucagcagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177895 - RNA, 1410 nt, Artificial Sequence; identical to SEQ ID NO: 177613
  derived and/or modified sequence opt4 from neuraminidase__InfluenzaA__AHZ40586

SEQ ID NO: 177896 - RNA, 1410 nt, Artificial Sequence
  derived and/or modified sequence opt4 from neuraminidase__InfluenzaA__AHZ40598
augaaccccaaccagaagaucaucaccaucggcagcgugugcaugaccaucggcauggccaaccugauccugcagaucggcaacaucaucagcaucuggaucagccacagcauccaggugggcaaccagagccagaucgagaccugcaaccagagcgugaucaccuacgagaacaacaccugggugaaccagaccuacgugaacaucagcaacaccaacuucgccgccggccagcccguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacgacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 177897 - RNA, 1410 nt, Artificial Sequence; identical to SEQ ID NO: 174666
  derived and/or modified sequence opt4 from neuraminidase__InfluenzaA__AHZ40609

SEQ ID NO: 177898 - RNA, 1410 nt, Artificial Sequence; identical to SEQ ID NO: 175895
  derived and/or modified sequence opt4 from neuraminidase__InfluenzaA__AHZ40629

SEQ ID NO: 177899 - RNA, 1410 nt, Artificial Sequence; identical to SEQ ID NO: 175877
  derived and/or modified sequence opt4 from neuraminidase__InfluenzaA__AHZ40641

SEQ ID NO: 177900 - RNA, 1410 nt, Artificial Sequence
  derived and/or modified sequence opt4 from neuraminidase__InfluenzaA__AHZ40653
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccggcuacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177901 - RNA, 1410 nt, Artificial Sequence; identical to SEQ ID NO: 175895
  derived and/or modified sequence opt4 from neuraminidase__InfluenzaA__AHZ40665

SEQ ID NO: 177902 - RNA, 1410 nt, Artificial Sequence; identical to SEQ ID NO: 175895
  derived and/or modified sequence opt4 from neuraminidase__InfluenzaA__AHZ40677

SEQ ID NO: 177903 - RNA, 1410 nt, Artificial Sequence; identical to SEQ ID NO: 174666
  derived and/or modified sequence opt4 from neuraminidase__InfluenzaA__AHZ40689

SEQ ID NO: 177904 - RNA, 1410 nt, Artificial Sequence
  derived and/or modified sequence opt4 from neuraminidase__InfluenzaA__AHZ40713
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacaagagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177905 - RNA, 1410 nt, Artificial Sequence
  derived and/or modified sequence opt4 from neuraminidase__InfluenzaA__AHZ40725
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcggcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177906 - RNA, 1410 nt, Artificial Sequence; identical to SEQ ID NO: 175884
  derived and/or modified sequence opt4 from neuraminidase__InfluenzaA__AHZ40737

SEQ ID NO: 177907 - RNA, 1410 nt, Artificial Sequence
  derived and/or modified sequence opt4 from neuraminidase__InfluenzaA__AHZ40749
augaaccccaaccagaagaucaucaccaucggcagcgugagccugaccaucagcaccaucugccuguucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggccccuggcccgacggcgccgaccugaaccugaugcccaucuga

SEQ ID NO: 177908 - RNA, 1410 nt, Artificial Sequence
  derived and/or modified sequence opt4 from neuraminidase__InfluenzaA__AHZ40761
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagcugugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcauggccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaagaaggagaccgccgugcuguggaccagcaacagcaucgugguguucugcggcaccagcggcaccuacggcaccggcagcuggcccgacggcgccgaccugaaccugaugcccaucuga

SEQ ID NO: 177909 - RNA, 1410 nt, Artificial Sequence; identical to SEQ ID NO: 174666
  derived and/or modified sequence opt4 from neuraminidase__InfluenzaA__AHZ40773

SEQ ID NO: 177910 - RNA, 1410 nt, Artificial Sequence; identical to SEQ ID NO: 169248
  derived and/or modified sequence opt4 from neuraminidase__InfluenzaA__AHZ40785

SEQ ID NO: 177911 - RNA, 1410 nt, Artificial Sequence; identical to SEQ ID NO: 169248
  derived and/or modified sequence opt4 from neuraminidase__InfluenzaA__AHZ40796

SEQ ID NO: 177912 - RNA, 1410 nt, Artificial Sequence; identical to SEQ ID NO: 169248
  derived and/or modified sequence opt4 from neuraminidase__InfluenzaA__AHZ40807

SEQ ID NO: 177913 - RNA, 1410 nt, Artificial Sequence; identical to SEQ ID NO: 169248
  derived and/or modified sequence opt4 from neuraminidase__InfluenzaA__AHZ40818

SEQ ID NO: 177914 - RNA, 1410 nt, Artificial Sequence; identical to SEQ ID NO: 169248
  derived and/or modified sequence opt4 from neuraminidase__InfluenzaA__AHZ40829

SEQ ID NO: 177915 - RNA, 1410 nt, Artificial Sequence; identical to SEQ ID NO: 169248
  derived and/or modified sequence opt4 from neuraminidase__InfluenzaA__AHZ40840

SEQ ID NO: 177916 - RNA, 1410 nt, Artificial Sequence; identical to SEQ ID NO: 169248
  derived and/or modified sequence opt4 from neuraminidase__InfluenzaA__AHZ40851

SEQ ID NO: 177917 - RNA, 1410 nt, Artificial Sequence; identical to SEQ ID NO: 169248
  derived and/or modified sequence opt4 from neuraminidase__InfluenzaA__AHZ40862

SEQ ID NO: 177918 - RNA, 1410 nt, Artificial Sequence; identical to SEQ ID NO: 169248
  derived and/or modified sequence opt4 from neuraminidase__InfluenzaA__AHZ40873

SEQ ID NO: 177919 - RNA, 1410 nt, Artificial Sequence; identical to SEQ ID NO: 169248
  derived and/or modified sequence opt4 from neuraminidase__InfluenzaA__AHZ40884

SEQ ID NO: 177920 - RNA, 1410 nt, Artificial Sequence; identical to SEQ ID NO: 169248
  derived and/or modified sequence opt4 from neuraminidase__InfluenzaA__AHZ40895

SEQ ID NO: 177921 - RNA, 1410 nt, Artificial Sequence; identical to SEQ ID NO: 169248
  derived and/or modified sequence opt4 from neuraminidase__InfluenzaA__AHZ40906

SEQ ID NO: 177922 - RNA, 1410 nt, Artificial Sequence; identical to SEQ ID NO: 169248
  derived and/or modified sequence opt4 from neuraminidase__InfluenzaA__AHZ40917

SEQ ID NO: 177923 - RNA, 1410 nt, Artificial Sequence; identical to SEQ ID NO: 169248
  derived and/or modified sequence opt4 from neuraminidase__InfluenzaA__AHZ40928

SEQ ID NO: 177924 - RNA, 1410 nt, Artificial Sequence; identical to SEQ ID NO: 169248
  derived and/or modified sequence opt4 from neuraminidase__InfluenzaA__AHZ40939

SEQ ID NO: 177925 - RNA, 1410 nt, Artificial Sequence; identical to SEQ ID NO: 169248
  derived and/or modified sequence opt4 from neuraminidase__InfluenzaA__AHZ40950

SEQ ID NO: 177926 - RNA, 1410 nt, Artificial Sequence; identical to SEQ ID NO: 169248
  derived and/or modified sequence opt4 from neuraminidase__InfluenzaA__AHZ40961

SEQ ID NO: 177927 - RNA, 1410 nt, Artificial Sequence; identical to SEQ ID NO: 169248
  derived and/or modified sequence opt4 from neuraminidase__InfluenzaA__AHZ40972

SEQ ID NO: 177928 - RNA, 1410 nt, Artificial Sequence; identical to SEQ ID NO: 169248
  derived and/or modified sequence opt4 from neuraminidase__InfluenzaA__AHZ40983

SEQ ID NO: 177929 - RNA, 1410 nt, Artificial Sequence; identical to SEQ ID NO: 169248
  derived and/or modified sequence opt4 from neuraminidase__InfluenzaA__AHZ40994

SEQ ID NO: 177930 - RNA, 1410 nt, Artificial Sequence; identical to SEQ ID NO: 169248
  derived and/or modified sequence opt4 from neuraminidase__InfluenzaA__AHZ41005

SEQ ID NO: 177931 - RNA, 1410 nt, Artificial Sequence; identical to SEQ ID NO: 169248
  derived and/or modified sequence opt4 from neuraminidase__InfluenzaA__AHZ41016

SEQ ID NO: 177932 - RNA, 1410 nt, Artificial Sequence; identical to SEQ ID NO: 169248
  derived and/or modified sequence opt4 from neuraminidase__InfluenzaA__AHZ41027

SEQ ID NO: 177933 - RNA, 1410 nt, Artificial Sequence; identical to SEQ ID NO: 169248
  derived and/or modified sequence opt4 from neuraminidase__InfluenzaA__AHZ41049

SEQ ID NO: 177934 - RNA, 1410 nt, Artificial Sequence; identical to SEQ ID NO: 169248
  derived and/or modified sequence opt4 from neuraminidase__InfluenzaA__AHZ41060

SEQ ID NO: 177935 - RNA, 1410 nt, Artificial Sequence; identical to SEQ ID NO: 169248
  derived and/or modified sequence opt4 from neuraminidase__InfluenzaA__AHZ41071

SEQ ID NO: 177936 - RNA, 1410 nt, Artificial Sequence; identical to SEQ ID NO: 169248
  derived and/or modified sequence opt4 from neuraminidase__InfluenzaA__AHZ41082

SEQ ID NO: 177937 - RNA, 1410 nt, Artificial Sequence; identical to SEQ ID NO: 169248
  derived and/or modified sequence opt4 from neuraminidase__InfluenzaA__AHZ41093

SEQ ID NO: 177938 - RNA, 1410 nt, Artificial Sequence; identical to SEQ ID NO: 169248
  derived and/or modified sequence opt4 from neuraminidase__InfluenzaA__AHZ41104

SEQ ID NO: 177939 - RNA, 1410 nt, Artificial Sequence; identical to SEQ ID NO: 169248
  derived and/or modified sequence opt4 from neuraminidase__InfluenzaA__AHZ41115

SEQ ID NO: 177940 - RNA, 1410 nt, Artificial Sequence; identical to SEQ ID NO: 169248
  derived and/or modified sequence opt4 from neuraminidase__InfluenzaA__AHZ41126

SEQ ID NO: 177941 - RNA, 1410 nt, Artificial Sequence; identical to SEQ ID NO: 169248
  derived and/or modified sequence opt4 from neuraminidase__InfluenzaA__AHZ41137

SEQ ID NO: 177942 - RNA, 1410 nt, Artificial Sequence; identical to SEQ ID NO: 169248
  derived and/or modified sequence opt4 from neuraminidase__InfluenzaA__AHZ41148

SEQ ID NO: 177943 - RNA, 1410 nt, Artificial Sequence; identical to SEQ ID NO: 169248
  derived and/or modified sequence opt4 from neuraminidase__InfluenzaA__AHZ41159

SEQ ID NO: 177944 - RNA, 1410 nt, Artificial Sequence; identical to SEQ ID NO: 169248
  derived and/or modified sequence opt4 from neuraminidase__InfluenzaA__AHZ41170

SEQ ID NO: 177945 - RNA, 1410 nt, Artificial Sequence; identical to SEQ ID NO: 169248
  derived and/or modified sequence opt4 from neuraminidase__InfluenzaA__AHZ41181

SEQ ID NO: 177946 - RNA, 1410 nt, Artificial Sequence; identical to SEQ ID NO: 169248
  derived and/or modified sequence opt4 from neuraminidase__InfluenzaA__AHZ41205

SEQ ID NO: 177947 - RNA, 1410 nt, Artificial Sequence; identical to SEQ ID NO: 169248
  derived and/or modified sequence opt4 from neuraminidase__InfluenzaA__AHZ41251

SEQ ID NO: 177948 - RNA, 1410 nt, Artificial Sequence; identical to SEQ ID NO: 169248
  derived and/or modified sequence opt4 from neuraminidase__InfluenzaA__AHZ41266

SEQ ID NO: 177949 - RNA, 1410 nt, Artificial Sequence; identical to SEQ ID NO: 169248
  derived and/or modified sequence opt4 from neuraminidase__InfluenzaA__AHZ41284

SEQ ID NO: 177950 - RNA, 1410 nt, Artificial Sequence; identical to SEQ ID NO: 169248
  derived and/or modified sequence opt4 from neuraminidase__InfluenzaA__AHZ41295

SEQ ID NO: 177951 - RNA, 1410 nt, Artificial Sequence; identical to SEQ ID NO: 169248
  derived and/or modified sequence opt4 from neuraminidase__InfluenzaA__AHZ41306

SEQ ID NO: 177952 - RNA, 1410 nt, Artificial Sequence; identical to SEQ ID NO: 169248
  derived and/or modified sequence opt4 from neuraminidase__InfluenzaA__AHZ41317

SEQ ID NO: 177953 - RNA, 1410 nt, Artificial Sequence; identical to SEQ ID NO: 169248
  derived and/or modified sequence opt4 from neuraminidase__InfluenzaA__AHZ41328

SEQ ID NO: 177954 - RNA, 1410 nt, Artificial Sequence; identical to SEQ ID NO: 169248
  derived and/or modified sequence opt4 from neuraminidase__InfluenzaA__AHZ41339

SEQ ID NO: 177955 - RNA, 1410 nt, Artificial Sequence; identical to SEQ ID NO: 169248
  derived and/or modified sequence opt4 from neuraminidase__InfluenzaA__AHZ41350

SEQ ID NO: 177956 - RNA, 1410 nt, Artificial Sequence; identical to SEQ ID NO: 169248
  derived and/or modified sequence opt4 from neuraminidase__InfluenzaA__AHZ41369

SEQ ID NO: 177957 - RNA, 1410 nt, Artificial Sequence; identical to SEQ ID NO: 169248
  derived and/or modified sequence opt4 from neuraminidase__InfluenzaA__AHZ41380

SEQ ID NO: 177958 - RNA, 1410 nt, Artificial Sequence; identical to SEQ ID NO: 169248
  derived and/or modified sequence opt4 from neuraminidase__InfluenzaA__AHZ41391

SEQ ID NO: 177959 - RNA, 1410 nt, Artificial Sequence; identical to SEQ ID NO: 169248
  derived and/or modified sequence opt4 from neuraminidase__InfluenzaA__AHZ41402

SEQ ID NO: 177960 - RNA, 1410 nt, Artificial Sequence; identical to SEQ ID NO: 169248
  derived and/or modified sequence opt4 from neuraminidase__InfluenzaA__AHZ41413

SEQ ID NO: 177961 - RNA, 1410 nt, Artificial Sequence; identical to SEQ ID NO: 169248
  derived and/or modified sequence opt4 from neuraminidase__InfluenzaA__AHZ41444

SEQ ID NO: 177962 - RNA, 1410 nt, Artificial Sequence; identical to SEQ ID NO: 169248
  derived and/or modified sequence opt4 from neuraminidase__InfluenzaA__AHZ41455

SEQ ID NO: 177963 - RNA, 1410 nt, Artificial Sequence; identical to SEQ ID NO: 169248
  derived and/or modified sequence opt4 from neuraminidase__InfluenzaA__AHZ41476

SEQ ID NO: 177964 - RNA, 1410 nt, Artificial Sequence; identical to SEQ ID NO: 169248
  derived and/or modified sequence opt4 from neuraminidase__InfluenzaA__AHZ41487

SEQ ID NO: 177965 - RNA, 1410 nt, Artificial Sequence; identical to SEQ ID NO: 169248
  derived and/or modified sequence opt4 from neuraminidase__InfluenzaA__AHZ41498

SEQ ID NO: 177966 - RNA, 1410 nt, Artificial Sequence; identical to SEQ ID NO: 169248
  derived and/or modified sequence opt4 from neuraminidase__InfluenzaA__AHZ41509

SEQ ID NO: 177967 - RNA, 1410 nt, Artificial Sequence; identical to SEQ ID NO: 169248
  derived and/or modified sequence opt4 from neuraminidase__InfluenzaA__AHZ41520

SEQ ID NO: 177968 - RNA, 1410 nt, Artificial Sequence; identical to SEQ ID NO: 169248
  derived and/or modified sequence opt4 from neuraminidase__InfluenzaA__AHZ41531

SEQ ID NO: 177969 - RNA, 1410 nt, Artificial Sequence; identical to SEQ ID NO: 169248
  derived and/or modified sequence opt4 from neuraminidase__InfluenzaA__AHZ41542

SEQ ID NO: 177970 - RNA, 1410 nt, Artificial Sequence; identical to SEQ ID NO: 169248
  derived and/or modified sequence opt4 from neuraminidase__InfluenzaA__AHZ41553

SEQ ID NO: 177971 - RNA, 1410 nt, Artificial Sequence; identical to SEQ ID NO: 169248
  derived and/or modified sequence opt4 from neuraminidase__InfluenzaA__AHZ41564

SEQ ID NO: 177972 - RNA, 1410 nt, Artificial Sequence; identical to SEQ ID NO: 169248
  derived and/or modified sequence opt4 from neuraminidase__InfluenzaA__AHZ41586

SEQ ID NO: 177973 - RNA, 1410 nt, Artificial Sequence; identical to SEQ ID NO: 169248
  derived and/or modified sequence opt4 from neuraminidase__InfluenzaA__AHZ41597

SEQ ID NO: 177974 - RNA, 1410 nt, Artificial Sequence; identical to SEQ ID NO: 169248
  derived and/or modified sequence opt4 from neuraminidase__InfluenzaA__AHZ41608

SEQ ID NO: 177975 - RNA, 1410 nt, Artificial Sequence; identical to SEQ ID NO: 169248
  derived and/or modified sequence opt4 from neuraminidase__InfluenzaA__AHZ41619

SEQ ID NO: 177976 - RNA, 1410 nt, Artificial Sequence; identical to SEQ ID NO: 169248
  derived and/or modified sequence opt4 from neuraminidase__InfluenzaA__AHZ41630

SEQ ID NO: 177977 - RNA, 1410 nt, Artificial Sequence; identical to SEQ ID NO: 169248
  derived and/or modified sequence opt4 from neuraminidase__InfluenzaA__AHZ41641

SEQ ID NO: 177978 - RNA, 1410 nt, Artificial Sequence; identical to SEQ ID NO: 169248
  derived and/or modified sequence opt4 from neuraminidase__InfluenzaA__AHZ41652

SEQ ID NO: 177979 - RNA, 1410 nt, Artificial Sequence; identical to SEQ ID NO: 169248
  derived and/or modified sequence opt4 from neuraminidase__InfluenzaA__AHZ41663

SEQ ID NO: 177980 - RNA, 1410 nt, Artificial Sequence; identical to SEQ ID NO: 169248
  derived and/or modified sequence opt4 from neuraminidase__InfluenzaA__AHZ41674

SEQ ID NO: 177981 - RNA, 1410 nt, Artificial Sequence; identical to SEQ ID NO: 169248
  derived and/or modified sequence opt4 from neuraminidase__InfluenzaA__AHZ41685

SEQ ID NO: 177982 - RNA, 1410 nt, Artificial Sequence; identical to SEQ ID NO: 169248
  derived and/or modified sequence opt4 from neuraminidase__InfluenzaA__AHZ41696

SEQ ID NO: 177983 - RNA, 1410 nt, Artificial Sequence; identical to SEQ ID NO: 169248
  derived and/or modified sequence opt4 from neuraminidase__InfluenzaA__AHZ41707

SEQ ID NO: 177984 - RNA, 1410 nt, Artificial Sequence; identical to SEQ ID NO: 169248
  derived and/or modified sequence opt4 from neuraminidase__InfluenzaA__AHZ41718

SEQ ID NO: 177985 - RNA, 1410 nt, Artificial Sequence; identical to SEQ ID NO: 169248
  derived and/or modified sequence opt4 from neuraminidase__InfluenzaA__AHZ41729

SEQ ID NO: 177986 - RNA, 1410 nt, Artificial Sequence; identical to SEQ ID NO: 169248
  derived and/or modified sequence opt4 from neuraminidase__InfluenzaA__AHZ41740

SEQ ID NO: 177987 - RNA, 1410 nt, Artificial Sequence; identical to SEQ ID NO: 169248
  derived and/or modified sequence opt4 from neuraminidase__InfluenzaA__AHZ41751

SEQ ID NO: 177988 - RNA, 1410 nt, Artificial Sequence; identical to SEQ ID NO: 169248
  derived and/or modified sequence opt4 from neuraminidase__InfluenzaA__AHZ41762

SEQ ID NO: 177989 - RNA, 1410 nt, Artificial Sequence; identical to SEQ ID NO: 175909
  derived and/or modified sequence opt4 from neuraminidase__InfluenzaA__AHZ42564

SEQ ID NO: 177990 - RNA, 1410 nt, Artificial Sequence; identical to SEQ ID NO: 174666
  derived and/or modified sequence opt4 from neuraminidase__InfluenzaA__AHZ42575

SEQ ID NO: 177991 - RNA, 1410 nt, Artificial Sequence
  derived and/or modified sequence opt4 from neuraminidase__InfluenzaA__AHZ42587
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaugugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177992 - RNA, 1413 nt, Artificial Sequence
  derived and/or modified sequence opt4 from neuraminidase__InfluenzaA__AHZ42599
augaaccccaaccagaagaucaucaccaucggcagcgugagccugaccaucagcaccaucugcuucuucaugcagaucgccauccugaucaccaccgugacccugcacuucaagcaguacgaguucaacagcccccccaagaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcgagaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 177993 - RNA, 1410 nt, Artificial Sequence; identical to SEQ ID NO: 177312
  derived and/or modified sequence opt4 from neuraminidase__InfluenzaA__AHZ42611

SEQ ID NO: 177994 - RNA, 1410 nt, Artificial Sequence; identical to SEQ ID NO: 174666
  derived and/or modified sequence opt4 from neuraminidase__InfluenzaA__AHZ42622

SEQ ID NO: 177995 - RNA, 1410 nt, Artificial Sequence; identical to SEQ ID NO: 177853
  derived and/or modified sequence opt4 from neuraminidase__InfluenzaA__AHZ42634

SEQ ID NO: 177996 - RNA, 1410 nt, Artificial Sequence; identical to SEQ ID NO: 177896
  derived and/or modified sequence opt4 from neuraminidase__InfluenzaA__AHZ42646

SEQ ID NO: 177997 - RNA, 1410 nt, Artificial Sequence; identical to SEQ ID NO: 174666
  derived and/or modified sequence opt4 from neuraminidase__InfluenzaA__AHZ42657

SEQ ID NO: 177998 - RNA, 1410 nt, Artificial Sequence; identical to SEQ ID NO: 177613
  derived and/or modified sequence opt4 from neuraminidase__InfluenzaA__AHZ42669

SEQ ID NO: 177999 - RNA, 1410 nt, Artificial Sequence; identical to SEQ ID NO: 174666
  derived and/or modified sequence opt4 from neuraminidase__InfluenzaA__AHZ42681

SEQ ID NO: 178000 - RNA, 1410 nt, Artificial Sequence
  derived and/or modified sequence opt4 from neuraminidase__InfluenzaA__AHZ42693
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaaguga

SEQ ID NO: 178001 - RNA, 1410 nt, Artificial Sequence; identical to SEQ ID NO: 174666
  derived and/or modified sequence opt4 from neuraminidase__InfluenzaA__AHZ42704

SEQ ID NO: 178002 - RNA, 1410 nt, Artificial Sequence
  derived and/or modified sequence opt4 from neuraminidase__InfluenzaA__AHZ42716
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaaguuccagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178003 - RNA, 1410 nt, Artificial Sequence; identical to SEQ ID NO: 174666
  derived and/or modified sequence opt4 from neuraminidase__InfluenzaA__AHZ42728

SEQ ID NO: 178004 - RNA, 1410 nt, Artificial Sequence; identical to SEQ ID NO: 175909
  derived and/or modified sequence opt4 from neuraminidase__InfluenzaA__AHZ42740

SEQ ID NO: 178005 - RNA, 1410 nt, Artificial Sequence; identical to SEQ ID NO: 175877
  derived and/or modified sequence opt4 from neuraminidase__InfluenzaA__AHZ42751

SEQ ID NO: 178006 - RNA, 1410 nt, Artificial Sequence
  derived and/or modified sequence opt4 from neuraminidase__InfluenzaA__AHZ42763
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucguguacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178007 - RNA, 1410 nt, Artificial Sequence; identical to SEQ ID NO: 175895
  derived and/or modified sequence opt4 from neuraminidase__InfluenzaA__AHZ42775

SEQ ID NO: 178008 - RNA, 1410 nt, Artificial Sequence; identical to SEQ ID NO: 174666
  derived and/or modified sequence opt4 from neuraminidase__InfluenzaA__AHZ42787

SEQ ID NO: 178009 - RNA, 1410 nt, Artificial Sequence
  derived and/or modified sequence opt4 from neuraminidase__InfluenzaA__AHZ42799
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucaucgacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178010 - RNA, 1410 nt, Artificial Sequence
  derived and/or modified sequence opt4 from neuraminidase__InfluenzaA__AHZ42811
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucgugggcagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178011 - RNA, 1410 nt, Artificial Sequence
  derived and/or modified sequence opt4 from neuraminidase__InfluenzaA__AHZ42823
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccgagcagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178012 - RNA, 1410 nt, Artificial Sequence
  derived and/or modified sequence opt4 from neuraminidase__InfluenzaA__AHZ42834
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178013 - RNA, 1410 nt, Artificial Sequence; identical to SEQ ID NO: 174666
  derived and/or modified sequence opt4 from neuraminidase__InfluenzaA__AHZ42846

SEQ ID NO: 178014 - RNA, 1410 nt, Artificial Sequence; identical to SEQ ID NO: 174666
  derived and/or modified sequence opt4 from neuraminidase__InfluenzaA__AHZ42858

SEQ ID NO: 178015 - RNA, 1410 nt, Artificial Sequence; identical to SEQ ID NO: 174666
  derived and/or modified sequence opt4 from neuraminidase__InfluenzaA__AHZ42870

SEQ ID NO: 178016 - RNA, 1410 nt, Artificial Sequence; identical to SEQ ID NO: 174666
  derived and/or modified sequence opt4 from neuraminidase__InfluenzaA__AHZ42882

SEQ ID NO: 178017 - RNA, 1410 nt, Artificial Sequence
  derived and/or modified sequence opt4 from neuraminidase__InfluenzaA__AHZ42894
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178018 - RNA, 1410 nt, Artificial Sequence; identical to SEQ ID NO: 174666
  derived and/or modified sequence opt4 from neuraminidase__InfluenzaA__AHZ42906

SEQ ID NO: 178019 - RNA, 1410 nt, Artificial Sequence; identical to SEQ ID NO: 175895
  derived and/or modified sequence opt4 from neuraminidase__InfluenzaA__AHZ42918

SEQ ID NO: 178020 - RNA, 1398 nt, Artificial Sequence; identical to SEQ ID NO: 175974
  derived and/or modified sequence opt4 from neuraminidase__InfluenzaA__AHZ59750

SEQ ID NO: 178021 - RNA, 1398 nt, Artificial Sequence; identical to SEQ ID NO: 175974
  derived and/or modified sequence opt4 from neuraminidase__InfluenzaA__AHZ59762

SEQ ID NO: 178022 - RNA, 1398 nt, Artificial Sequence; identical to SEQ ID NO: 175974
  derived and/or modified sequence opt4 from neuraminidase__InfluenzaA__AHZ59774

SEQ ID NO: 178023 - RNA, 1398 nt, Artificial Sequence; identical to SEQ ID NO: 175974
  derived and/or modified sequence opt4 from neuraminidase__InfluenzaA__AHZ59786

SEQ ID NO: 178024 - RNA, 1398 nt, Artificial Sequence; identical to SEQ ID NO: 175974
  derived and/or modified sequence opt4 from neuraminidase__InfluenzaA__AHZ59798

SEQ ID NO: 178025 - RNA, 1398 nt, Artificial Sequence; identical to SEQ ID NO: 175974
  derived and/or modified sequence opt4 from neuraminidase__InfluenzaA__AHZ59810

SEQ ID NO: 178026 - RNA, 1398 nt, Artificial Sequence; identical to SEQ ID NO: 175974
  derived and/or modified sequence opt4 from neuraminidase__InfluenzaA__AHZ59822

SEQ ID NO: 178027 - RNA, 1398 nt, Artificial Sequence; identical to SEQ ID NO: 175974
  derived and/or modified sequence opt4 from neuraminidase__InfluenzaA__AHZ59834

SEQ ID NO: 178028 - RNA, 1398 nt, Artificial Sequence; identical to SEQ ID NO: 175974
  derived and/or modified sequence opt4 from neuraminidase__InfluenzaA__AHZ59846

SEQ ID NO: 178029 - RNA, 1398 nt, Artificial Sequence; identical to SEQ ID NO: 175974
  derived and/or modified sequence opt4 from neuraminidase__InfluenzaA__AHZ59858

SEQ ID NO: 178030 - RNA, 1398 nt, Artificial Sequence; identical to SEQ ID NO: 175974
  derived and/or modified sequence opt4 from neuraminidase__InfluenzaA__AHZ59870

SEQ ID NO: 178031 - RNA, 1398 nt, Artificial Sequence; identical to SEQ ID NO: 175974
  derived and/or modified sequence opt4 from neuraminidase__InfluenzaA__AHZ59882

SEQ ID NO: 178032 - RNA, 1398 nt, Artificial Sequence; identical to SEQ ID NO: 175974
  derived and/or modified sequence opt4 from neuraminidase__InfluenzaA__AHZ59918

SEQ ID NO: 178033 - RNA, 1398 nt, Artificial Sequence; identical to SEQ ID NO: 175974
  derived and/or modified sequence opt4 from neuraminidase__InfluenzaA__AHZ59930

SEQ ID NO: 178034 - RNA, 1398 nt, Artificial Sequence; identical to SEQ ID NO: 175974
  derived and/or modified sequence opt4 from neuraminidase__InfluenzaA__AHZ59942

SEQ ID NO: 178035 - RNA, 1398 nt, Artificial Sequence; identical to SEQ ID NO: 175974
  derived and/or modified sequence opt4 from neuraminidase__InfluenzaA__AHZ59954

SEQ ID NO: 178036 - RNA, 1398 nt, Artificial Sequence; identical to SEQ ID NO: 175974
  derived and/or modified sequence opt4 from neuraminidase__InfluenzaA__AHZ59966

SEQ ID NO: 178037 - RNA, 1398 nt, Artificial Sequence; identical to SEQ ID NO: 175974
  derived and/or modified sequence opt4 from neuraminidase__InfluenzaA__AHZ59991

SEQ ID NO: 178038 - RNA, 1398 nt, Artificial Sequence; identical to SEQ ID NO: 175974
  derived and/or modified sequence opt4 from neuraminidase__InfluenzaA__AHZ60003

SEQ ID NO: 178039 - RNA, 1398 nt, Artificial Sequence; identical to SEQ ID NO: 175974
  derived and/or modified sequence opt4 from neuraminidase__InfluenzaA__AHZ60015

SEQ ID NO: 178040 - RNA, 1398 nt, Artificial Sequence; identical to SEQ ID NO: 175974
  derived and/or modified sequence opt4 from neuraminidase__InfluenzaA__AHZ60027

SEQ ID NO: 178041 - RNA, 1398 nt, Artificial Sequence; identical to SEQ ID NO: 175974
  derived and/or modified sequence opt4 from neuraminidase__InfluenzaA__AHZ60039

SEQ ID NO: 178042 - RNA, 1398 nt, Artificial Sequence; identical to SEQ ID NO: 175974
  derived and/or modified sequence opt4 from neuraminidase__InfluenzaA__AHZ60051

SEQ ID NO: 178043 - RNA, 1398 nt, Artificial Sequence; identical to SEQ ID NO: 175974
  derived and/or modified sequence opt4 from neuraminidase__InfluenzaA__AHZ60063

SEQ ID NO: 178044 - RNA, 1398 nt, Artificial Sequence; identical to SEQ ID NO: 175974
  derived and/or modified sequence opt4 from neuraminidase__InfluenzaA__AHZ60075

SEQ ID NO: 178045 - RNA, 1398 nt, Artificial Sequence; identical to SEQ ID NO: 175974
  derived and/or modified sequence opt4 from neuraminidase__InfluenzaA__AHZ60087

SEQ ID NO: 178046 - RNA, 1398 nt, Artificial Sequence; identical to SEQ ID NO: 175974
  derived and/or modified sequence opt4 from neuraminidase__InfluenzaA__AHZ60099

SEQ ID NO: 178047 - RNA, 1410 nt, Artificial Sequence; identical to SEQ ID NO: 174666
  derived and/or modified sequence opt4 from neuraminidase__InfluenzaA__AHZ60111

SEQ ID NO: 178048 - RNA, 1410 nt, Artificial Sequence; identical to SEQ ID NO: 168922
  derived and/or modified sequence opt4 from neuraminidase__InfluenzaA__AIA26299

SEQ ID NO: 178049 - RNA, 1374 nt, Artificial Sequence
  derived and/or modified sequence opt4 from neuraminidase__InfluenzaA__AIC64891
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178050 - RNA, 1350 nt, Artificial Sequence
  derived and/or modified sequence opt4 from neuraminidase__InfluenzaA__AID48084
augaaccccaacaagaagaucaucaccaucggcagcaucugcauggugaccggcauggugagccugaugcugcagaucggcaaccugaucagcaucugggugagccacagcauccacaccggcaaccagcacaaggccgagcccaucagcaacaccaaccugcugaccgagaagaccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcgccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 178051 - RNA, 1410 nt, Artificial Sequence
  derived and/or modified sequence opt4 from neuraminidase__InfluenzaA__AID70507
augaaccccaaccagaagaucaucaccaucggcagcgugugcaccaccaucggcauggccaaccugauccugcagaucggcaacaucaucagcaucuggaucagccacagcauccagcugggcaaccagaaccagaucgagaccugcaaccagagcgugaucaccuacgagaacaagaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcgaccccgugagcuucaacggcgccaacggcgugaagggcuucagcuucaaguacggcaacggcguguggaucggcagaaccaagagcaucagcagcagaaacggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcugguucuggcccgacggcgccgagcugcccuucaccaucgacaaguga

SEQ ID NO: 178052 - RNA, 1410 nt, Artificial Sequence
  derived and/or modified sequence opt4 from neuraminidase__InfluenzaA__AID70508
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccaacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178053 - RNA, 1410 nt, Artificial Sequence
  derived and/or modified sequence opt4 from neuraminidase__InfluenzaA__AID70509
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucaacagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178054 - RNA, 1410 nt, Artificial Sequence
  derived and/or modified sequence opt4 from neuraminidase__InfluenzaA__AID70510
augaaccccaaccagaagaucaucaccaucggcagcgugugcaucaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178055 - RNA, 1410 nt, Artificial Sequence
  derived and/or modified sequence opt4 from neuraminidase__InfluenzaA__AID70511
augaaccccaaccagaagaucaucaccaugggcagcguguggaugaccaucggcauggccaaccugauccugcagagcggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178056 - RNA, 1410 nt, Artificial Sequence
  derived and/or modified sequence opt4 from neuraminidase__InfluenzaA__AID70512
augaaccccaaccagaagaucaucaccaucggcagcguguggaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178057 - RNA, 1410 nt, Artificial Sequence; identical to SEQ ID NO: 172777
  derived and/or modified sequence opt4 from neuraminidase__InfluenzaA__AID70514

SEQ ID NO: 178058 - RNA, 1410 nt, Artificial Sequence
  derived and/or modified sequence opt4 from neuraminidase__InfluenzaA__AID70515
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacagcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178059 - RNA, 1410 nt, Artificial Sequence; identical to SEQ ID NO: 175678
  derived and/or modified sequence opt4 from neuraminidase__InfluenzaA__AID70516

SEQ ID NO: 178060 - RNA, 1410 nt, Artificial Sequence
  derived and/or modified sequence opt4 from neuraminidase__InfluenzaA__AID70517
augaaccccaaccagaagaucaucaccaucggcagcgugugcaugaccaucggcauggccaaccugacccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178061 - RNA, 1410 nt, Artificial Sequence
  derived and/or modified sequence opt4 from neuraminidase__InfluenzaA__AID70518
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgagauccccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178062 - RNA, 1410 nt, Artificial Sequence
  derived and/or modified sequence opt4 from neuraminidase__InfluenzaA__AID70519
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178063 - RNA, 1410 nt, Artificial Sequence
  derived and/or modified sequence opt4 from neuraminidase__InfluenzaA__AID70520
augaaccccaaccagaagaucaucaccaucggcagcgugugcaugaccaucggcauggccaaccugauccugcagaucggcaacaucaucagcaucuggaucagccacagcauccagcugagaaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 178064 - RNA, 1410 nt, Artificial Sequence
  derived and/or modified sequence opt4 from neuraminidase__InfluenzaA__AID70521
augaaccccaaccagaagaucaucaccaucggcagcgugagccugaccaucagcagaaucugcuucuucaugcagaucgccauccugaucaacaccgugacccugcacuucaagcaguacgaguucaacagcccccccaacaaccaggugaugcugugcgagcccaccaucaucgagagaaacaucaccaagaucguguaccugaccaacaccaccaucgagaaggagaucugccccaagcuggccgaguacagaagcuggagcaagccccagugcgacaucaccggcuucgcccccuucagcaaggacaacagcaucagacugagcgccggcggcgacaucugggugaccagagagcccuacgugagcugcgaccccgacaagugcuuccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcaucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggcuucgugggcgacacccccagaaagcccgacagaagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucggcggcuggagcaaccccaacagcaagagccagaucaacagacaggugaucguggacagaggcaacagaagcggcuacagcggcaucuucagcguggagggcaagagcugcaucaacagaugcuucuacguggagcugaucagaggcagaaaggacgagaccgaggugcuguggaccagcaacagcaucgugguguucugcggcaccagcggcaccuacggcaccggcagcuggcccgacggcgccgacaucaaccugaugcccaucuga

SEQ ID NO: 178065 - RNA, 1410 nt, Artificial Sequence
  derived and/or modified sequence opt4 from neuraminidase__InfluenzaA__AID70522
augaaccccaaccagaagaucaucaccaucggcagcgugagccugaccaucagcaccaucugcuucuucaugcagaucgccauccugaucaccaccgugacccugcacuucagacaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178066 - RNA, 1410 nt, Artificial Sequence
  derived and/or modified sequence opt4 from neuraminidase__InfluenzaA__AID70523
augaaccccaaccagaagaucaagaccaucggcagcgugagccugaccaacagcaccaucugcaucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaguucaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178067 - RNA, 1410 nt, Artificial Sequence
  derived and/or modified sequence opt4 from neuraminidase__InfluenzaA__AID70524
augaaccccaaccagaagaucaucaccaucggcgccguguggagaaccaucagcaccaucugcuucuucaugcagaucgccuuccugaucaccaccgugacccugcacuucaagcaguacgaguucaacagcccccccaacaaccaggugaugcccugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178068 - RNA, 1410 nt, Artificial Sequence
  derived and/or modified sequence opt4 from neuraminidase__InfluenzaA__AID70525
augaaccccaaccagaagaucaucaccaucggcagcgugagccugaccaucuggaucaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaacaucaugcccaucuga

SEQ ID NO: 178069 - RNA, 1410 nt, Artificial Sequence; identical to SEQ ID NO: 172038
  derived and/or modified sequence opt4 from neuraminidase__InfluenzaA__AID70526

SEQ ID NO: 178070 - RNA, 1410 nt, Artificial Sequence
  derived and/or modified sequence opt4 from neuraminidase__InfluenzaA__AID70527
augaaccccaaccagaagaucaucaccaucggcagcgugagccugaccauguggaucaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178071 - RNA, 1410 nt, Artificial Sequence
  derived and/or modified sequence opt4 from neuraminidase__InfluenzaA__AID70528
augaaccccaaccagaagaucaucaccaucggcagcgugagccugagcaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178072 - RNA, 1410 nt, Artificial Sequence; identical to SEQ ID NO: 172038
  derived and/or modified sequence opt4 from neuraminidase__InfluenzaA__AID70529

SEQ ID NO: 178073 - RNA, 1410 nt, Artificial Sequence
  derived and/or modified sequence opt4 from neuraminidase__InfluenzaA__AID70530
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaacaucaugcccaucuga

SEQ ID NO: 178074 - RNA, 1410 nt, Artificial Sequence; identical to SEQ ID NO: 172038
  derived and/or modified sequence opt4 from neuraminidase__InfluenzaA__AID70531

SEQ ID NO: 178075 - RNA, 1410 nt, Artificial Sequence
  derived and/or modified sequence opt4 from neuraminidase__InfluenzaA__AID70532
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagacccugaaggugaucgagggcuggagcaaccccaagagcaagcugcagaucaacagacaggugaucguggacagaggcaacagaagcggcuacuacggcaucuucagcguggagggcaagagcugcaucaacagaugcuucuacguggagcugaucuggggcagaaaggaggagaucgaggugcuguggaccagcaacagcaaggugguguucugcggcaccagcggcaccuacggcaccggcagcagccccgacggcgccgaccugaacuucaugcccaucuga

SEQ ID NO: 178076 - RNA, 1410 nt, Artificial Sequence
  derived and/or modified sequence opt4 from neuraminidase__InfluenzaA__AID70533
augaaccccaaccagaagaucaucaccaucggcagcgugagccuggccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178077 - RNA, 1410 nt, Artificial Sequence
  derived and/or modified sequence opt4 from neuraminidase__InfluenzaA__AID70534
augaaccccaaccagaagaucaucaccaucggcagcgugagccugagcaucuacaucaucugcuucuucaugcagaucgccauccugaucaccaccgugacccugcacuucaagcaguacgaguucaacagcccccccaacaaccaggccaugcccugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178078 - RNA, 1410 nt, Artificial Sequence
  derived and/or modified sequence opt4 from neuraminidase__InfluenzaA__AID70535
augaaccccaaccagaagaucaucaccaucggcagcgugagccuggccaugugcaccaucugcuucuucaugcagaucgccauccugaucaccaccgugacccugcacuucaagcaguacgaguucaacagcccccccaacaaccaggccaugcccugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178079 - RNA, 1410 nt, Artificial Sequence
  derived and/or modified sequence opt4 from neuraminidase__InfluenzaA__AID70536
augaaccccaaccagaagaucaucaccaucggcagcgugagccugaccaucagcaccgugugcuucuucaugcagaucgccauccugaucaccaccgugacccugcacuucaagcaguacgaguucaacagcccccccaacaaccaggugaugcugugcgagcccaccaucaucgacagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178080 - RNA, 1410 nt, Artificial Sequence; identical to SEQ ID NO: 172038
  derived and/or modified sequence opt4 from neuraminidase__InfluenzaA__AID70537

SEQ ID NO: 178081 - RNA, 1410 nt, Artificial Sequence
  derived and/or modified sequence opt4 from neuraminidase__InfluenzaA__AID70538
augaaccccaaccagaagaagaucaccaucggcgccgugagccugaccaugugcaccgugugcaucuucaugcagaucgccauccugaucaccaccgugacccugcacuucagacaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178082 - RNA, 1410 nt, Artificial Sequence
  derived and/or modified sequence opt4 from neuraminidase__InfluenzaA__AID70539
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178083 - RNA, 1410 nt, Artificial Sequence; identical to SEQ ID NO: 172038
  derived and/or modified sequence opt4 from neuraminidase__InfluenzaA__AID70540

SEQ ID NO: 178084 - RNA, 1410 nt, Artificial Sequence; identical to SEQ ID NO: 172038
  derived and/or modified sequence opt4 from neuraminidase__InfluenzaA__AID70541

SEQ ID NO: 178085 - RNA, 1410 nt, Artificial Sequence
  derived and/or modified sequence opt4 from neuraminidase__InfluenzaA__AID70633
augaaccccaaccagaagaucaucaccaucggcagcgugugcaugaccaucggcauggccaaccugauccugcagaucggcaacaucaucagcaucugggugagccacagcauccagcugggcaaccagagccagaucgaggccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178086 - RNA, 1398 nt, Artificial Sequence
  derived and/or modified sequence opt4 from neuraminidase__InfluenzaA__AID70635
augaaccccaagcagaagauccugugcaccagcgccaccgccaucaucaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacggcagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 178087 - RNA, 1401 nt, Artificial Sequence
  derived and/or modified sequence opt4 from neuraminidase__InfluenzaA__AIG44695
augaaccccaaccagaagaucaccgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccagcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacgugugcgugaccggcgacgacaagaacgccaccgccagcaucaucuacgacggcaugcugguggacagcgugggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacggcuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 178088 - RNA, 1410 nt, Artificial Sequence
  derived and/or modified sequence opt4 from neuraminidase__InfluenzaA__AIJ10793
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggccaucgagggcuggagcaaccccaagagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178089 - RNA, 1410 nt, Artificial Sequence; identical to SEQ ID NO: 172038
  derived and/or modified sequence opt4 from neuraminidase__InfluenzaA__AIJ10794

SEQ ID NO: 178090 - RNA, 1410 nt, Artificial Sequence; identical to SEQ ID NO: 173663
  derived and/or modified sequence opt4 from neuraminidase__InfluenzaA__AIJ10795

SEQ ID NO: 178091 - RNA, 1410 nt, Artificial Sequence; identical to SEQ ID NO: 173663
  derived and/or modified sequence opt4 from neuraminidase__InfluenzaA__AIJ10796

SEQ ID NO: 178092 - RNA, 1410 nt, Artificial Sequence
  derived and/or modified sequence opt4 from neuraminidase__InfluenzaA__AIJ10797
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggaggacaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178093 - RNA, 1410 nt, Artificial Sequence
  derived and/or modified sequence opt4 from neuraminidase__InfluenzaA__AIJ10798
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccacccuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178094 - RNA, 1410 nt, Artificial Sequence; identical to SEQ ID NO: 173663
  derived and/or modified sequence opt4 from neuraminidase__InfluenzaA__AIJ10799

SEQ ID NO: 178095 - RNA, 1410 nt, Artificial Sequence
  derived and/or modified sequence opt4 from neuraminidase__InfluenzaA__AIJ10800
augaaccccaaccagaagaucaucaccaucggcagcgugagccugaccaucagcaccaucugcuucuucaugcagaucgccauccugaucaccaccgugacccugcacuucaagcaguacgaguucaacagcagccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcaagcugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178096 - RNA, 1410 nt, Artificial Sequence; identical to SEQ ID NO: 174666
  derived and/or modified sequence opt4 from neuraminidase__InfluenzaA__AIJ10801

SEQ ID NO: 178097 - RNA, 1410 nt, Artificial Sequence; identical to SEQ ID NO: 174666
  derived and/or modified sequence opt4 from neuraminidase__InfluenzaA__AIJ10803

SEQ ID NO: 178098 - RNA, 1410 nt, Artificial Sequence; identical to SEQ ID NO: 174666
  derived and/or modified sequence opt4 from neuraminidase__InfluenzaA__AIJ10804

SEQ ID NO: 178099 - RNA, 1410 nt, Artificial Sequence; identical to SEQ ID NO: 174666
  derived and/or modified sequence opt4 from neuraminidase__InfluenzaA__AIJ10805

SEQ ID NO: 178100 - RNA, 1410 nt, Artificial Sequence
  derived and/or modified sequence opt4 from neuraminidase__InfluenzaA__AIJ10806
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcaucagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178101 - RNA, 1410 nt, Artificial Sequence
  derived and/or modified sequence opt4 from neuraminidase__InfluenzaA__AIJ10807
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagaggccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178102 - RNA, 1410 nt, Artificial Sequence
  derived and/or modified sequence opt4 from neuraminidase__InfluenzaA__AIJ10808
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggaggugcugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178103 - RNA, 1410 nt, Artificial Sequence; identical to SEQ ID NO: 174666
  derived and/or modified sequence opt4 from neuraminidase__InfluenzaA__AIJ10809

SEQ ID NO: 178104 - RNA, 1410 nt, Artificial Sequence; identical to SEQ ID NO: 174666
  derived and/or modified sequence opt4 from neuraminidase__InfluenzaA__AIJ10810

SEQ ID NO: 178105 - RNA, 1410 nt, Artificial Sequence
  derived and/or modified sequence opt4 from neuraminidase__InfluenzaA__AIJ10812
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucauggagagaaacgugaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178106 - RNA, 1410 nt, Artificial Sequence
  derived and/or modified sequence opt4 from neuraminidase__InfluenzaA__AIJ10813
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucauggagagaaacgugaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaaccccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178107 - RNA, 1410 nt, Artificial Sequence
  derived and/or modified sequence opt4 from neuraminidase__InfluenzaA__AIJ10814
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucguggagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacaagggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178108 - RNA, 1410 nt, Artificial Sequence
  derived and/or modified sequence opt4 from neuraminidase__InfluenzaA__AIJ10815
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 178109 - RNA, 1410 nt, Artificial Sequence
  derived and/or modified sequence opt4 from neuraminidase__InfluenzaA__AIJ10816
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagggcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178110 - RNA, 1410 nt, Artificial Sequence; identical to SEQ ID NO: 174666
  derived and/or modified sequence opt4 from neuraminidase__InfluenzaA__AIJ10817

SEQ ID NO: 178111 - RNA, 1410 nt, Artificial Sequence; identical to SEQ ID NO: 174666
  derived and/or modified sequence opt4 from neuraminidase__InfluenzaA__AIJ10818

SEQ ID NO: 178112 - RNA, 1410 nt, Artificial Sequence
  derived and/or modified sequence opt4 from neuraminidase__InfluenzaA__AIJ10819
augaaccccaaccagaagaucaucaccaucggcagcgugagccugaccaucagcaccaucugcuucuucaugcagaucgccauccugaucaccaccguggcccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccaacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178113 - RNA, 1410 nt, Artificial Sequence; identical to SEQ ID NO: 174666
  derived and/or modified sequence opt4 from neuraminidase__InfluenzaA__AIJ10820

SEQ ID NO: 178114 - RNA, 1410 nt, Artificial Sequence; identical to SEQ ID NO: 174666
  derived and/or modified sequence opt4 from neuraminidase__InfluenzaA__AIJ10821

SEQ ID NO: 178115 - RNA, 1410 nt, Artificial Sequence
  derived and/or modified sequence opt4 from neuraminidase__InfluenzaA__AIJ10822
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 178116 - RNA, 1410 nt, Artificial Sequence
  derived and/or modified sequence opt4 from neuraminidase__InfluenzaA__AIJ10823
augaaccccaaccagaagaucaucaccaucggcagcgugagccugaccaucagcaccaucugcuucuucaugcagaucgccauccugaucaccaccgugacccugcacuucaaccaguacgaguucaacagcccccccaacaaccaggugaugcugugcgagcccaccaucaucgagagaaacaucaccgagaucguguaccugaccaccaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuucagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgugaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcggcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178117 - RNA, 1410 nt, Artificial Sequence
  derived and/or modified sequence opt4 from neuraminidase__InfluenzaA__AIJ10824
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178118 - RNA, 1410 nt, Artificial Sequence
  derived and/or modified sequence opt4 from neuraminidase__InfluenzaA__AIJ10827
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178119 - RNA, 1410 nt, Artificial Sequence
  derived and/or modified sequence opt4 from neuraminidase__InfluenzaA__AIJ10828
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugguguggaccagcaacagcaucgugguguucugcggcaccagcggcaccuacggcaccggcagcuggcccgacggcgccgaccugaaccugaugcccaucuga

SEQ ID NO: 178120 - RNA, 1410 nt, Artificial Sequence
  derived and/or modified sequence opt4 from neuraminidase__InfluenzaA__AIJ10829
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaacugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178121 - RNA, 1410 nt, Artificial Sequence
  derived and/or modified sequence opt4 from neuraminidase__InfluenzaA__AIJ10830
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacaagaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178122 - RNA, 1410 nt, Artificial Sequence; identical to SEQ ID NO: 178118
  derived and/or modified sequence opt4 from neuraminidase__InfluenzaA__AIJ10831

SEQ ID NO: 178123 - RNA, 1410 nt, Artificial Sequence; identical to SEQ ID NO: 178118
  derived and/or modified sequence opt4 from neuraminidase__InfluenzaA__AIJ10832

SEQ ID NO: 178124 - RNA, 1410 nt, Artificial Sequence
  derived and/or modified sequence opt4 from neuraminidase__InfluenzaA__AIJ10834
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagagcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178125 - RNA, 1410 nt, Artificial Sequence
  derived and/or modified sequence opt4 from neuraminidase__InfluenzaA__AIJ10835
augaaccccaaccagaagaucaucaccaucggcagcgugagccugaccaucagcaccaucugcuucuucaugcagaucgccauccugaucaccaccgugacccugcacuucaagcaguacgaguucaacagcacccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178126 - RNA, 1410 nt, Artificial Sequence; identical to SEQ ID NO: 178118
  derived and/or modified sequence opt4 from neuraminidase__InfluenzaA__AIJ10836

SEQ ID NO: 178127 - RNA, 1410 nt, Artificial Sequence
  derived and/or modified sequence opt4 from neuraminidase__InfluenzaA__AIJ10837
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178128 - RNA, 1410 nt, Artificial Sequence; identical to SEQ ID NO: 178118
  derived and/or modified sequence opt4 from neuraminidase__InfluenzaA__AIJ10838

SEQ ID NO: 178129 - RNA, 1410 nt, Artificial Sequence
  derived and/or modified sequence opt4 from neuraminidase__InfluenzaA__AIJ10841
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178130 - RNA, 1410 nt, Artificial Sequence
  derived and/or modified sequence opt4 from neuraminidase__InfluenzaA__AIJ10842
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178131 - RNA, 1410 nt, Artificial Sequence; identical to SEQ ID NO: 178118
  derived and/or modified sequence opt4 from neuraminidase__InfluenzaA__AIJ10843

SEQ ID NO: 178132 - RNA, 1410 nt, Artificial Sequence
  derived and/or modified sequence opt4 from neuraminidase__InfluenzaA__AIJ10844
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuucagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgugaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcggcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucaagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178133 - RNA, 1410 nt, Artificial Sequence
  derived and/or modified sequence opt4 from neuraminidase__InfluenzaA__AIJ10845
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaucaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuucagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgugaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcggcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178134 - RNA, 1410 nt, Artificial Sequence
  derived and/or modified sequence opt4 from neuraminidase__InfluenzaA__AIJ10847
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178135 - RNA, 1410 nt, Artificial Sequence; identical to SEQ ID NO: 178118
  derived and/or modified sequence opt4 from neuraminidase__InfluenzaA__AIJ10848

SEQ ID NO: 178136 - RNA, 1410 nt, Artificial Sequence
  derived and/or modified sequence opt4 from neuraminidase__InfluenzaA__AIJ10849
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuucagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgugaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcggcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178137 - RNA, 1410 nt, Artificial Sequence; identical to SEQ ID NO: 178136
  derived and/or modified sequence opt4 from neuraminidase__InfluenzaA__AIJ10851

SEQ ID NO: 178138 - RNA, 1410 nt, Artificial Sequence; identical to SEQ ID NO: 178136
  derived and/or modified sequence opt4 from neuraminidase__InfluenzaA__AIJ10852

SEQ ID NO: 178139 - RNA, 1410 nt, Artificial Sequence; identical to SEQ ID NO: 178132
  derived and/or modified sequence opt4 from neuraminidase__InfluenzaA__AIJ10853

SEQ ID NO: 178140 - RNA, 1410 nt, Artificial Sequence; identical to SEQ ID NO: 178132
  derived and/or modified sequence opt4 from neuraminidase__InfluenzaA__AIJ10854

SEQ ID NO: 178141 - RNA, 1410 nt, Artificial Sequence
  derived and/or modified sequence opt4 from neuraminidase__InfluenzaA__AIJ10855
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuucagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgugaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcggcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178142 - RNA, 1410 nt, Artificial Sequence
  derived and/or modified sequence opt4 from neuraminidase__InfluenzaA__AIJ10856
augaaccccaacaagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaagaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcuucagcagcggccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcaucgagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178143 - RNA, 1410 nt, Artificial Sequence; identical to SEQ ID NO: 178118
  derived and/or modified sequence opt4 from neuraminidase__InfluenzaA__AIJ10857

SEQ ID NO: 178144 - RNA, 1410 nt, Artificial Sequence; identical to SEQ ID NO: 174666
  derived and/or modified sequence opt4 from neuraminidase__InfluenzaA__AIJ29348

SEQ ID NO: 178145 - RNA, 1410 nt, Artificial Sequence; identical to SEQ ID NO: 174666
  derived and/or modified sequence opt4 from neuraminidase__InfluenzaA__AIJ29350

SEQ ID NO: 178146 - RNA, 1410 nt, Artificial Sequence
  derived and/or modified sequence opt4 from neuraminidase__InfluenzaA__AIJ29352
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccaaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178147 - RNA, 1410 nt, Artificial Sequence; identical to SEQ ID NO: 173663
  derived and/or modified sequence opt4 from neuraminidase__InfluenzaA__AIJ29354

SEQ ID NO: 178148 - RNA, 1410 nt, Artificial Sequence; identical to SEQ ID NO: 175442
  derived and/or modified sequence opt4 from neuraminidase__InfluenzaA__AIJ29356

SEQ ID NO: 178149 - RNA, 1410 nt, Artificial Sequence; identical to SEQ ID NO: 175442
  derived and/or modified sequence opt4 from neuraminidase__InfluenzaA__AIJ29358

SEQ ID NO: 178150 - RNA, 1410 nt, Artificial Sequence
  derived and/or modified sequence opt4 from neuraminidase__InfluenzaA__AIJ29360
augaaccccaaccagaagaucaucaccaucggcagcgugagccugaccaucagcaccaucugcuucuucaugcagaucgccauccugaccaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178151 - RNA, 1410 nt, Artificial Sequence; identical to SEQ ID NO: 174666
  derived and/or modified sequence opt4 from neuraminidase__InfluenzaA__AIJ29362

SEQ ID NO: 178152 - RNA, 1410 nt, Artificial Sequence
  derived and/or modified sequence opt4 from neuraminidase__InfluenzaA__AIL93626
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccuacgugaaccagaccuacgugaacaucagcaacaccaacuucgccgccggcagaagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugcugagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178153 - RNA, 1410 nt, Artificial Sequence
  derived and/or modified sequence opt4 from neuraminidase__InfluenzaA__AIL93648
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcagaaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178154 - RNA, 1410 nt, Artificial Sequence; identical to SEQ ID NO: 174666
  derived and/or modified sequence opt4 from neuraminidase__InfluenzaA__AIL93660

SEQ ID NO: 178155 - RNA, 1410 nt, Artificial Sequence; identical to SEQ ID NO: 174666
  derived and/or modified sequence opt4 from neuraminidase__InfluenzaA__AIL93672

SEQ ID NO: 178156 - RNA, 1410 nt, Artificial Sequence
  derived and/or modified sequence opt4 from neuraminidase__InfluenzaA__AIL93684
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacagcgccaccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugcugagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggaucgagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178157 - RNA, 1410 nt, Artificial Sequence
  derived and/or modified sequence opt4 from neuraminidase__InfluenzaA__AIL93719
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178158 - RNA, 1410 nt, Artificial Sequence; identical to SEQ ID NO: 178157
  derived and/or modified sequence opt4 from neuraminidase__InfluenzaA__AIL93743

SEQ ID NO: 178159 - RNA, 1410 nt, Artificial Sequence; identical to SEQ ID NO: 178157
  derived and/or modified sequence opt4 from neuraminidase__InfluenzaA__AIL93755

SEQ ID NO: 178160 - RNA, 1410 nt, Artificial Sequence; identical to SEQ ID NO: 174666
  derived and/or modified sequence opt4 from neuraminidase__InfluenzaA__AIL93767

SEQ ID NO: 178161 - RNA, 1410 nt, Artificial Sequence; identical to SEQ ID NO: 174666
  derived and/or modified sequence opt4 from neuraminidase__InfluenzaA__AIL93779

SEQ ID NO: 178162 - RNA, 1410 nt, Artificial Sequence
  derived and/or modified sequence opt4 from neuraminidase__InfluenzaA__AIL93791
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagaacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178163 - RNA, 1410 nt, Artificial Sequence; identical to SEQ ID NO: 178157
  derived and/or modified sequence opt4 from neuraminidase__InfluenzaA__AIL93803

SEQ ID NO: 178164 - RNA, 1410 nt, Artificial Sequence
  derived and/or modified sequence opt4 from neuraminidase__InfluenzaA__AIL93815
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucguguacagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178165 - RNA, 1410 nt, Artificial Sequence; identical to SEQ ID NO: 174666
  derived and/or modified sequence opt4 from neuraminidase__InfluenzaA__AIL93827

SEQ ID NO: 178166 - RNA, 1410 nt, Artificial Sequence
  derived and/or modified sequence opt4 from neuraminidase__InfluenzaA__AIL93839
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccaccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178167 - RNA, 1410 nt, Artificial Sequence
  derived and/or modified sequence opt4 from neuraminidase__InfluenzaA__AIL93850
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccaccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaagggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178168 - RNA, 1410 nt, Artificial Sequence; identical to SEQ ID NO: 178157
  derived and/or modified sequence opt4 from neuraminidase__InfluenzaA__AIL93861

SEQ ID NO: 178169 - RNA, 1410 nt, Artificial Sequence
  derived and/or modified sequence opt4 from neuraminidase__InfluenzaA__AIL93885
augaaccccaaccagaagaucaucaccaucggcagcgugagccugaccaucagcaccaucugcuucuucaugcagaucgccauccugaucaccaccgugacccugcacuucaagcaguacgaguucgacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcguguucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178170 - RNA, 1410 nt, Artificial Sequence; identical to SEQ ID NO: 178157
  derived and/or modified sequence opt4 from neuraminidase__InfluenzaA__AIL93897

SEQ ID NO: 178171 - RNA, 1410 nt, Artificial Sequence
  derived and/or modified sequence opt4 from neuraminidase__InfluenzaA__AIL93909
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgugugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178172 - RNA, 1410 nt, Artificial Sequence; identical to SEQ ID NO: 178157
  derived and/or modified sequence opt4 from neuraminidase__InfluenzaA__AIL93920

SEQ ID NO: 178173 - RNA, 1410 nt, Artificial Sequence
  derived and/or modified sequence opt4 from neuraminidase__InfluenzaA__AIL93943
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagccccagcgagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178174 - RNA, 1410 nt, Artificial Sequence; identical to SEQ ID NO: 178157
  derived and/or modified sequence opt4 from neuraminidase__InfluenzaA__AIL93954

SEQ ID NO: 178175 - RNA, 1410 nt, Artificial Sequence; identical to SEQ ID NO: 178157
  derived and/or modified sequence opt4 from neuraminidase__InfluenzaA__AIL93966

SEQ ID NO: 178176 - RNA, 1410 nt, Artificial Sequence
  derived and/or modified sequence opt4 from neuraminidase__InfluenzaA__AIL93978
augaaccccaaccagaagaucaucaccaucggcagcgugagccugaccaucagcaccaucugccuguucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178177 - RNA, 1410 nt, Artificial Sequence; identical to SEQ ID NO: 178166
  derived and/or modified sequence opt4 from neuraminidase__InfluenzaA__AIL93990

SEQ ID NO: 178178 - RNA, 1410 nt, Artificial Sequence; identical to SEQ ID NO: 174666
  derived and/or modified sequence opt4 from neuraminidase__InfluenzaA__AIL94001

SEQ ID NO: 178179 - RNA, 1410 nt, Artificial Sequence; identical to SEQ ID NO: 178157
  derived and/or modified sequence opt4 from neuraminidase__InfluenzaA__AIL94013

SEQ ID NO: 178180 - RNA, 1410 nt, Artificial Sequence; identical to SEQ ID NO: 178157
  derived and/or modified sequence opt4 from neuraminidase__InfluenzaA__AIL94025

SEQ ID NO: 178181 - RNA, 1410 nt, Artificial Sequence; identical to SEQ ID NO: 178157
  derived and/or modified sequence opt4 from neuraminidase__InfluenzaA__AIL94037

SEQ ID NO: 178182 - RNA, 1410 nt, Artificial Sequence; identical to SEQ ID NO: 178157
  derived and/or modified sequence opt4 from neuraminidase__InfluenzaA__AIL94049

SEQ ID NO: 178183 - RNA, 1410 nt, Artificial Sequence; identical to SEQ ID NO: 178166
  derived and/or modified sequence opt4 from neuraminidase__InfluenzaA__AIL94061

SEQ ID NO: 178184 - RNA, 1410 nt, Artificial Sequence
  derived and/or modified sequence opt4 from neuraminidase__InfluenzaA__AIL94072
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccaccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugcugagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggaucgagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178185 - RNA, 1410 nt, Artificial Sequence; identical to SEQ ID NO: 178166
  derived and/or modified sequence opt4 from neuraminidase__InfluenzaA__AIL94083

SEQ ID NO: 178186 - RNA, 1410 nt, Artificial Sequence; identical to SEQ ID NO: 178157
  derived and/or modified sequence opt4 from neuraminidase__InfluenzaA__AIL94238

SEQ ID NO: 178187 - RNA, 1410 nt, Artificial Sequence
  derived and/or modified sequence opt4 from neuraminidase__InfluenzaA__AIL94250
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccaacgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178188 - RNA, 1410 nt, Artificial Sequence; identical to SEQ ID NO: 174666
  derived and/or modified sequence opt4 from neuraminidase__InfluenzaA__AIL94261

SEQ ID NO: 178189 - RNA, 1410 nt, Artificial Sequence; identical to SEQ ID NO: 174666
  derived and/or modified sequence opt4 from neuraminidase__InfluenzaA__AIL94273

SEQ ID NO: 178190 - RNA, 1410 nt, Artificial Sequence; identical to SEQ ID NO: 174666
  derived and/or modified sequence opt4 from neuraminidase__InfluenzaA__AIL94285

SEQ ID NO: 178191 - RNA, 1410 nt, Artificial Sequence
  derived and/or modified sequence opt4 from neuraminidase__InfluenzaA__AIL94297
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagaacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178192 - RNA, 1410 nt, Artificial Sequence; identical to SEQ ID NO: 178157
  derived and/or modified sequence opt4 from neuraminidase__InfluenzaA__AIL94309

SEQ ID NO: 178193 - RNA, 1410 nt, Artificial Sequence; identical to SEQ ID NO: 178176
  derived and/or modified sequence opt4 from neuraminidase__InfluenzaA__AIL94321

SEQ ID NO: 178194 - RNA, 1410 nt, Artificial Sequence; identical to SEQ ID NO: 174666
  derived and/or modified sequence opt4 from neuraminidase__InfluenzaA__AIL94368

SEQ ID NO: 178195 - RNA, 1410 nt, Artificial Sequence
  derived and/or modified sequence opt4 from neuraminidase__InfluenzaA__AIL94380
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccgugguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178196 - RNA, 1410 nt, Artificial Sequence
  derived and/or modified sequence opt4 from neuraminidase__InfluenzaA__AIL94392
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178197 - RNA, 1410 nt, Artificial Sequence
  derived and/or modified sequence opt4 from neuraminidase__InfluenzaA__AIL94403
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcgaccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178198 - RNA, 1410 nt, Artificial Sequence; identical to SEQ ID NO: 174666
  derived and/or modified sequence opt4 from neuraminidase__InfluenzaA__AIL94426

SEQ ID NO: 178199 - RNA, 1410 nt, Artificial Sequence
  derived and/or modified sequence opt4 from neuraminidase__InfluenzaA__AIL94438
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccaccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcgugagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178200 - RNA, 1410 nt, Artificial Sequence
  derived and/or modified sequence opt4 from neuraminidase__InfluenzaA__AIL94449
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccaaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucguguacagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178201 - RNA, 1410 nt, Artificial Sequence; identical to SEQ ID NO: 178195
  derived and/or modified sequence opt4 from neuraminidase__InfluenzaA__AIL94461

SEQ ID NO: 178202 - RNA, 1410 nt, Artificial Sequence
  derived and/or modified sequence opt4 from neuraminidase__InfluenzaA__AIL94473
augaaccccaaccagaagaucaucaccaucggcagcgugugcaugaccaucggcauggccaaccugauccugcagaucggcaacaucaucagcaucugggugggccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacacccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaucgugggcuggagcuggcccgacggcgccgagcugcccuucaccaucgacaaguga

SEQ ID NO: 178203 - RNA, 1410 nt, Artificial Sequence; identical to SEQ ID NO: 177256
  derived and/or modified sequence opt4 from neuraminidase__InfluenzaA__AIL94484

SEQ ID NO: 178204 - RNA, 1410 nt, Artificial Sequence; identical to SEQ ID NO: 178166
  derived and/or modified sequence opt4 from neuraminidase__InfluenzaA__AIL94507

SEQ ID NO: 178205 - RNA, 1410 nt, Artificial Sequence
  derived and/or modified sequence opt4 from neuraminidase__InfluenzaA__AIL94518
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugagccugaugcccaucuga

SEQ ID NO: 178206 - RNA, 1410 nt, Artificial Sequence
  derived and/or modified sequence opt4 from neuraminidase__InfluenzaA__AIL94530
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178207 - RNA, 1410 nt, Artificial Sequence; identical to SEQ ID NO: 178196
  derived and/or modified sequence opt4 from neuraminidase__InfluenzaA__AIL94542

SEQ ID NO: 178208 - RNA, 1410 nt, Artificial Sequence; identical to SEQ ID NO: 178166
  derived and/or modified sequence opt4 from neuraminidase__InfluenzaA__AIL94553

SEQ ID NO: 178209 - RNA, 1410 nt, Artificial Sequence; identical to SEQ ID NO: 178157
  derived and/or modified sequence opt4 from neuraminidase__InfluenzaA__AIL94564

SEQ ID NO: 178210 - RNA, 1410 nt, Artificial Sequence; identical to SEQ ID NO: 178166
  derived and/or modified sequence opt4 from neuraminidase__InfluenzaA__AIL94576

SEQ ID NO: 178211 - RNA, 1410 nt, Artificial Sequence
  derived and/or modified sequence opt4 from neuraminidase__InfluenzaA__AIL94587
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagauggacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaacggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccggcggcagcagcaucagcuucugcggcgugaacagcgacaccgugggcuggagcuggcccgacggcgccgagcugcccuucaccaucgacaaguga

SEQ ID NO: 178212 - RNA, 1410 nt, Artificial Sequence; identical to SEQ ID NO: 178196
  derived and/or modified sequence opt4 from neuraminidase__InfluenzaA__AIL94598

SEQ ID NO: 178213 - RNA, 1410 nt, Artificial Sequence
  derived and/or modified sequence opt4 from neuraminidase__InfluenzaA__AIL94609
augaaccccaaccagaagaucaucaccaucggcagcgugagccugaccaucagcaccaucugccuguucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugagcgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuacccccuguaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178214 - RNA, 1410 nt, Artificial Sequence
  derived and/or modified sequence opt4 from neuraminidase__InfluenzaA__AIL94621
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178215 - RNA, 1410 nt, Artificial Sequence; identical to SEQ ID NO: 178166
  derived and/or modified sequence opt4 from neuraminidase__InfluenzaA__AIL94632

SEQ ID NO: 178216 - RNA, 1410 nt, Artificial Sequence; identical to SEQ ID NO: 174666
  derived and/or modified sequence opt4 from neuraminidase__InfluenzaA__AIL94643

SEQ ID NO: 178217 - RNA, 1410 nt, Artificial Sequence
  derived and/or modified sequence opt4 from neuraminidase__InfluenzaA__AIL94655
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178218 - RNA, 1410 nt, Artificial Sequence
  derived and/or modified sequence opt4 from neuraminidase__InfluenzaA__AIL94677
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178219 - RNA, 1410 nt, Artificial Sequence; identical to SEQ ID NO: 178157
  derived and/or modified sequence opt4 from neuraminidase__InfluenzaA__AIL94688

SEQ ID NO: 178220 - RNA, 1410 nt, Artificial Sequence
  derived and/or modified sequence opt4 from neuraminidase__InfluenzaA__AIL94700
augaaccccaaccagaagaucaucaccaucggcagcgugagccugaccaucagcaccaucugcuucuucaugcagaucgccauccugaucaccaucgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacaucgaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178221 - RNA, 1410 nt, Artificial Sequence; identical to SEQ ID NO: 178166
  derived and/or modified sequence opt4 from neuraminidase__InfluenzaA__AIL94712

SEQ ID NO: 178222 - RNA, 1410 nt, Artificial Sequence; identical to SEQ ID NO: 178196
  derived and/or modified sequence opt4 from neuraminidase__InfluenzaA__AIL94723

SEQ ID NO: 178223 - RNA, 1410 nt, Artificial Sequence
  derived and/or modified sequence opt4 from neuraminidase__InfluenzaA__AIL94734
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgagcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178224 - RNA, 1410 nt, Artificial Sequence; identical to SEQ ID NO: 178166
  derived and/or modified sequence opt4 from neuraminidase__InfluenzaA__AIL94746

SEQ ID NO: 178225 - RNA, 1410 nt, Artificial Sequence; identical to SEQ ID NO: 178196
  derived and/or modified sequence opt4 from neuraminidase__InfluenzaA__AIL94757

SEQ ID NO: 178226 - RNA, 1410 nt, Artificial Sequence; identical to SEQ ID NO: 178157
  derived and/or modified sequence opt4 from neuraminidase__InfluenzaA__AIL94768

SEQ ID NO: 178227 - RNA, 1410 nt, Artificial Sequence; identical to SEQ ID NO: 174666
  derived and/or modified sequence opt4 from neuraminidase__InfluenzaA__AIL94780

SEQ ID NO: 178228 - RNA, 1410 nt, Artificial Sequence; identical to SEQ ID NO: 178196
  derived and/or modified sequence opt4 from neuraminidase__InfluenzaA__AIL94803

SEQ ID NO: 178229 - RNA, 1410 nt, Artificial Sequence; identical to SEQ ID NO: 178176
  derived and/or modified sequence opt4 from neuraminidase__InfluenzaA__AIL94814

SEQ ID NO: 178230 - RNA, 1410 nt, Artificial Sequence
  derived and/or modified sequence opt4 from neuraminidase__InfluenzaA__AIL94826
augaaccccaaccagaagaucaucaccaucggcagcgugagccugaccaucagcaccaucugcuucuucaugcagaucgccauccugaucaccaccgugacccugcacuucaagcaguacgaguucaacagccugcccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178231 - RNA, 1410 nt, Artificial Sequence
  derived and/or modified sequence opt4 from neuraminidase__InfluenzaA__AIL94850
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcuguucgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucaaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacagcgaggagggcggccacggcgugaagggcugggccuucgacgacggcaacgacguguggaugggcagaaccaucagcgagaagagcagacugggcuacgagaccuucaaggugaucgagggcuggagcaaccccaagagcaaguuccagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178232 - RNA, 1410 nt, Artificial Sequence; identical to SEQ ID NO: 171930
  derived and/or modified sequence opt4 from neuraminidase__InfluenzaA__AIL94862

SEQ ID NO: 178233 - RNA, 1410 nt, Artificial Sequence; identical to SEQ ID NO: 171930
  derived and/or modified sequence opt4 from neuraminidase__InfluenzaA__AIL94874

SEQ ID NO: 178234 - RNA, 1410 nt, Artificial Sequence
  derived and/or modified sequence opt4 from neuraminidase__InfluenzaA__AIL94886
augaaccccaaccagaagaucaucaccaucggcagcgugugcaugaccaucggcauggccaaccugaugcugcagaucggcaacaucaucagcaucuggaucagccacagcauccagcugggcaacaagaaccagaucgagaccugcaaccagagcgugaucaccuacgagaacaacaccugggugaaccagaccuacgugaacaucagcaacaccaacuucgccgccggccagagcguggugagcgugaagaucgccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacgacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagaccccacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178235 - RNA, 1410 nt, Artificial Sequence; identical to SEQ ID NO: 175442
  derived and/or modified sequence opt4 from neuraminidase__InfluenzaA__AIL94897

SEQ ID NO: 178236 - RNA, 1410 nt, Artificial Sequence; identical to SEQ ID NO: 178230
  derived and/or modified sequence opt4 from neuraminidase__InfluenzaA__AIL94909

SEQ ID NO: 178237 - RNA, 1410 nt, Artificial Sequence; identical to SEQ ID NO: 174666
  derived and/or modified sequence opt4 from neuraminidase__InfluenzaA__AIL94921

SEQ ID NO: 178238 - RNA, 1410 nt, Artificial Sequence; identical to SEQ ID NO: 174666
  derived and/or modified sequence opt4 from neuraminidase__InfluenzaA__AIL94933

SEQ ID NO: 178239 - RNA, 1410 nt, Artificial Sequence; identical to SEQ ID NO: 178157
  derived and/or modified sequence opt4 from neuraminidase__InfluenzaA__AIL94945

SEQ ID NO: 178240 - RNA, 1410 nt, Artificial Sequence
  derived and/or modified sequence opt4 from neuraminidase__InfluenzaA__AIL94957
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagauggacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaacggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178241 - RNA, 1410 nt, Artificial Sequence; identical to SEQ ID NO: 178230
  derived and/or modified sequence opt4 from neuraminidase__InfluenzaA__AIL94968

SEQ ID NO: 178242 - RNA, 1410 nt, Artificial Sequence
  derived and/or modified sequence opt4 from neuraminidase__InfluenzaA__AIM55840
augaaccccaaccagaagaucaucaccaucggcagcgugugcaugaccaucggcauggccaaccugauccugcagaucggcaacaucaucagcaucuggaucagccacagcauccaggugggcaaccagagccagaucgagaucugcaaccagagcgugaucaccuacgagaacaacaccugggugaaccagaccuacgugaacaucagcaacaccaacuucgccgccggccagcccguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacgacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuucgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178243 - RNA, 1410 nt, Artificial Sequence
  derived and/or modified sequence opt4 from neuraminidase__InfluenzaA__AIM55851
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcagaaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaagagcgacaccgugggcuggagcuggcccgacggcgccgagcugcccuucaccaucgacaaguga

SEQ ID NO: 178244 - RNA, 1410 nt, Artificial Sequence
  derived and/or modified sequence opt4 from neuraminidase__InfluenzaA__AIM55862
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucaagaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaacggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178245 - RNA, 1410 nt, Artificial Sequence
  derived and/or modified sequence opt4 from neuraminidase__InfluenzaA__AIM55873
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178246 - RNA, 1410 nt, Artificial Sequence; identical to SEQ ID NO: 178245
  derived and/or modified sequence opt4 from neuraminidase__InfluenzaA__AIM55884

SEQ ID NO: 178247 - RNA, 1410 nt, Artificial Sequence; identical to SEQ ID NO: 178245
  derived and/or modified sequence opt4 from neuraminidase__InfluenzaA__AIM55918

SEQ ID NO: 178248 - RNA, 1410 nt, Artificial Sequence
  derived and/or modified sequence opt4 from neuraminidase__InfluenzaA__AIM55929
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaccggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178249 - RNA, 1410 nt, Artificial Sequence
  derived and/or modified sequence opt4 from neuraminidase__InfluenzaA__AIM55940
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcagcaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178250 - RNA, 1410 nt, Artificial Sequence
  derived and/or modified sequence opt4 from neuraminidase__InfluenzaA__AIM55965
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacgccgugggcuggagcuggcccgacggcgccgagcugcccuucaccaucgacaaguga

SEQ ID NO: 178251 - RNA, 1410 nt, Artificial Sequence
  derived and/or modified sequence opt4 from neuraminidase__InfluenzaA__AIM55976
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178252 - RNA, 1410 nt, Artificial Sequence
  derived and/or modified sequence opt4 from neuraminidase__InfluenzaA__AIM55987
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaccggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccguggacuggagcuggcccgacggcgccgagcugcccuucaccaucgacaaguga

SEQ ID NO: 178253 - RNA, 1410 nt, Artificial Sequence
  derived and/or modified sequence opt4 from neuraminidase__InfluenzaA__AIM55998
augaaccccaaccagaagaucaucaccaucggcagcgugugcaugaccaucggcauggccaaccugauccugcagaucggcaacaccaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaagagcgacaccgugggcuggagcuggcccgacggcgccgagcugcccuucaccaucgacaaguga

SEQ ID NO: 178254 - RNA, 1410 nt, Artificial Sequence; identical to SEQ ID NO: 178251
  derived and/or modified sequence opt4 from neuraminidase__InfluenzaA__AIM56009

SEQ ID NO: 178255 - RNA, 1410 nt, Artificial Sequence; identical to SEQ ID NO: 178251
  derived and/or modified sequence opt4 from neuraminidase__InfluenzaA__AIM56020

SEQ ID NO: 178256 - RNA, 1410 nt, Artificial Sequence; identical to SEQ ID NO: 178251
  derived and/or modified sequence opt4 from neuraminidase__InfluenzaA__AIM56031

SEQ ID NO: 178257 - RNA, 1410 nt, Artificial Sequence
  derived and/or modified sequence opt4 from neuraminidase__InfluenzaA__AIM56042
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178258 - RNA, 1410 nt, Artificial Sequence
  derived and/or modified sequence opt4 from neuraminidase__InfluenzaA__AIM56053
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacgagcaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178259 - RNA, 1410 nt, Artificial Sequence
  derived and/or modified sequence opt4 from neuraminidase__InfluenzaA__AIM56064
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcuggugagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178260 - RNA, 1410 nt, Artificial Sequence
  derived and/or modified sequence opt4 from neuraminidase__InfluenzaA__AIM56086
augaaccccaaccagaagaucaucaccaucggcagcgugugcaugaccaucggcauggccaaccugauccugcagaucggcaacaucaucagcaucugggugagccacagcauccagcugggcaaccagagccacaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugaccagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucaucggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178261 - RNA, 1410 nt, Artificial Sequence
  derived and/or modified sequence opt4 from neuraminidase__InfluenzaA__AIM56097
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccgagcagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178262 - RNA, 1410 nt, Artificial Sequence
  derived and/or modified sequence opt4 from neuraminidase__InfluenzaA__AIM56108
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccuggaucaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178263 - RNA, 1410 nt, Artificial Sequence
  derived and/or modified sequence opt4 from neuraminidase__InfluenzaA__AIM56119
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178264 - RNA, 1410 nt, Artificial Sequence
  derived and/or modified sequence opt4 from neuraminidase__InfluenzaA__AIM56130
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaagagcgacaccgugggcuggagcuggcccgacggcgccgagcugcccuucaccaucgacaaguga

SEQ ID NO: 178265 - RNA, 1410 nt, Artificial Sequence
  derived and/or modified sequence opt4 from neuraminidase__InfluenzaA__AIM56141
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaucuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178266 - RNA, 1410 nt, Artificial Sequence; identical to SEQ ID NO: 178251
  derived and/or modified sequence opt4 from neuraminidase__InfluenzaA__AIM56152

SEQ ID NO: 178267 - RNA, 1410 nt, Artificial Sequence
  derived and/or modified sequence opt4 from neuraminidase__InfluenzaA__AIM56163
augaaccccaaccagaagaucaucaccaucggcagcgugugcaugaccaucggcauggccaaccugauccugcagaucggcaacaucaucagcaucugggugagccacagcauccagcugggcaaccagagccacaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugaccagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178268 - RNA, 1410 nt, Artificial Sequence
  derived and/or modified sequence opt4 from neuraminidase__InfluenzaA__AIM56174
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccguggacaaguga

SEQ ID NO: 178269 - RNA, 1410 nt, Artificial Sequence; identical to SEQ ID NO: 178264
  derived and/or modified sequence opt4 from neuraminidase__InfluenzaA__AIM56185

SEQ ID NO: 178270 - RNA, 1410 nt, Artificial Sequence; identical to SEQ ID NO: 178263
  derived and/or modified sequence opt4 from neuraminidase__InfluenzaA__AIM56196

SEQ ID NO: 178271 - RNA, 1410 nt, Artificial Sequence; identical to SEQ ID NO: 178245
  derived and/or modified sequence opt4 from neuraminidase__InfluenzaA__AIM56207

SEQ ID NO: 178272 - RNA, 1410 nt, Artificial Sequence
  derived and/or modified sequence opt4 from neuraminidase__InfluenzaA__AIM56229
augaaccccaaccagaagaucaucaccaucggcagcgugugcaugaccaucggcauggccaaccugauccugcagaucggcaacaccaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccacgccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178273 - RNA, 1410 nt, Artificial Sequence
  derived and/or modified sequence opt4 from neuraminidase__InfluenzaA__AIM56240
augaaccccaaccagaagaucaucaccaucggcagcgugugcaugaccaucggcauggccaaccugauccugcagaucggcaacaucaucagcaucuggaucagccacagcauccaggugggcaaccagagccagaucgagaccugcaaccagagcgugaucaccuacgagaacaacaccugggugaaccagaccuacgugaacaucagcaacaccaacuucgccgccggccagcccguggugagcgugaagcuggccggcaacagcagccugugcagcgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacgacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178274 - RNA, 1410 nt, Artificial Sequence
  derived and/or modified sequence opt4 from neuraminidase__InfluenzaA__AIM56251
augaaccccaaccagaagaucaucaccaucggcagcgugugcaugaccaucggcauggccaaccugauccugcagaucggcaacaucaucagcaucugggugagccacagcauccagcugggcaaccagagccacaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178275 - RNA, 1410 nt, Artificial Sequence; identical to SEQ ID NO: 178274
  derived and/or modified sequence opt4 from neuraminidase__InfluenzaA__AIM56262

SEQ ID NO: 178276 - RNA, 1410 nt, Artificial Sequence; identical to SEQ ID NO: 178245
  derived and/or modified sequence opt4 from neuraminidase__InfluenzaA__AIM56273

SEQ ID NO: 178277 - RNA, 1410 nt, Artificial Sequence
  derived and/or modified sequence opt4 from neuraminidase__InfluenzaA__AIM56284
augaaccccaaccagaagaucaucaccaucggcagcgugugcaucaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacguggugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178278 - RNA, 1410 nt, Artificial Sequence; identical to SEQ ID NO: 178245
  derived and/or modified sequence opt4 from neuraminidase__InfluenzaA__AIM56295

SEQ ID NO: 178279 - RNA, 1410 nt, Artificial Sequence; identical to SEQ ID NO: 178245
  derived and/or modified sequence opt4 from neuraminidase__InfluenzaA__AIM56306

SEQ ID NO: 178280 - RNA, 1410 nt, Artificial Sequence; identical to SEQ ID NO: 178245
  derived and/or modified sequence opt4 from neuraminidase__InfluenzaA__AIM56317

SEQ ID NO: 178281 - RNA, 1410 nt, Artificial Sequence; identical to SEQ ID NO: 178264
  derived and/or modified sequence opt4 from neuraminidase__InfluenzaA__AIM56339

SEQ ID NO: 178282 - RNA, 1410 nt, Artificial Sequence
  derived and/or modified sequence opt4 from neuraminidase__InfluenzaA__AIM56350
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcaucaacagcgacaccgugggcuggagcuggcccgacggcgccgagcugcccuucaccaucgacaaguga

SEQ ID NO: 178283 - RNA, 1410 nt, Artificial Sequence; identical to SEQ ID NO: 178274
  derived and/or modified sequence opt4 from neuraminidase__InfluenzaA__AIM56361

SEQ ID NO: 178284 - RNA, 1410 nt, Artificial Sequence; identical to SEQ ID NO: 178245
  derived and/or modified sequence opt4 from neuraminidase__InfluenzaA__AIM56372

SEQ ID NO: 178285 - RNA, 1410 nt, Artificial Sequence; identical to SEQ ID NO: 178274
  derived and/or modified sequence opt4 from neuraminidase__InfluenzaA__AIM56383

SEQ ID NO: 178286 - RNA, 1410 nt, Artificial Sequence
  derived and/or modified sequence opt4 from neuraminidase__InfluenzaA__AIM56394
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178287 - RNA, 1410 nt, Artificial Sequence; identical to SEQ ID NO: 178263
  derived and/or modified sequence opt4 from neuraminidase__InfluenzaA__AIM56405

SEQ ID NO: 178288 - RNA, 1410 nt, Artificial Sequence
  derived and/or modified sequence opt4 from neuraminidase__InfluenzaA__AIM56416
augaaccccaaccagaagaucaucaccaucggcagcgugugcaugaccaucggcauggccaaccugauccugcagaucggcaacaucaucagcaucugggugagccacagcauccagcugggcaaccagagccacaucgagaccugcaaccagagcgugaucaccuacgagaacaacaccugggugaaccagaccuacgugaacaucagcaacaucaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugaccagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178289 - RNA, 1410 nt, Artificial Sequence; identical to SEQ ID NO: 178263
  derived and/or modified sequence opt4 from neuraminidase__InfluenzaA__AIM56428

SEQ ID NO: 178290 - RNA, 1410 nt, Artificial Sequence; identical to SEQ ID NO: 178245
  derived and/or modified sequence opt4 from neuraminidase__InfluenzaA__AIM56439

SEQ ID NO: 178291 - RNA, 1410 nt, Artificial Sequence
  derived and/or modified sequence opt4 from neuraminidase__InfluenzaA__AIM56450
augaaccccaaccagaagaucaucaccaucggcagcgugugcaugaccaucggcauggccaaccugauccugcagaucggcaacaucaucagcaucuggaucagccacagcauccaggugggcaaccagagccagaucgagaccugcaaccagagcgugaucaccuacgagaacaacaccugggugaaccagaccuacgugaacaucagcaacaccaacuucgccgccggccagcccguggugagcgugaagcuggccggcaacagcagccugugccccgugagcggcugggccaucuacagcaaggacaacagcgugagagugggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacgacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguacaagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcgugaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178292 - RNA, 1410 nt, Artificial Sequence
  derived and/or modified sequence opt4 from neuraminidase__InfluenzaA__AIM56461
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcgugaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178293 - RNA, 1410 nt, Artificial Sequence
  derived and/or modified sequence opt4 from neuraminidase__InfluenzaA__AIM56472
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugcaacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178294 - RNA, 1410 nt, Artificial Sequence; identical to SEQ ID NO: 178251
  derived and/or modified sequence opt4 from neuraminidase__InfluenzaA__AIM56483

SEQ ID NO: 178295 - RNA, 1410 nt, Artificial Sequence; identical to SEQ ID NO: 178274
  derived and/or modified sequence opt4 from neuraminidase__InfluenzaA__AIM56494

SEQ ID NO: 178296 - RNA, 1410 nt, Artificial Sequence; identical to SEQ ID NO: 178264
  derived and/or modified sequence opt4 from neuraminidase__InfluenzaA__AIM56505

SEQ ID NO: 178297 - RNA, 1410 nt, Artificial Sequence; identical to SEQ ID NO: 178263
  derived and/or modified sequence opt4 from neuraminidase__InfluenzaA__AIM56516

SEQ ID NO: 178298 - RNA, 1410 nt, Artificial Sequence
  derived and/or modified sequence opt4 from neuraminidase__InfluenzaA__AIM56527
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccgagcagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcgugcugggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagauggugugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178299 - RNA, 1410 nt, Artificial Sequence; identical to SEQ ID NO: 178245
  derived and/or modified sequence opt4 from neuraminidase__InfluenzaA__AIM56538

SEQ ID NO: 178300 - RNA, 1410 nt, Artificial Sequence
  derived and/or modified sequence opt4 from neuraminidase__InfluenzaA__AIM56549
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgaggugaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178301 - RNA, 1410 nt, Artificial Sequence
  derived and/or modified sequence opt4 from neuraminidase__InfluenzaA__AIM56560
augaaccccaaccagaagaucaucaccaucggcagcgugugcaugaccaucggcauggccaaccugauccugcagaucggcaacaucaucagcaucugggugagccacagcauccagcugggcaaccagagccacaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccauccacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugaccagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178302 - RNA, 1410 nt, Artificial Sequence; identical to SEQ ID NO: 178251
  derived and/or modified sequence opt4 from neuraminidase__InfluenzaA__AIM56571

SEQ ID NO: 178303 - RNA, 1410 nt, Artificial Sequence
  derived and/or modified sequence opt4 from neuraminidase__InfluenzaA__AIM56582
augaaccccaaccagaagaucaucaccaucggcagcgugugcaucaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178304 - RNA, 1410 nt, Artificial Sequence
  derived and/or modified sequence opt4 from neuraminidase__InfluenzaA__AIM56593
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccgagcagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcgugcugggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccgagaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178305 - RNA, 1410 nt, Artificial Sequence
  derived and/or modified sequence opt4 from neuraminidase__InfluenzaA__AIM56604
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaucaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178306 - RNA, 1410 nt, Artificial Sequence
  derived and/or modified sequence opt4 from neuraminidase__InfluenzaA__AIM56615
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacguggacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacagcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178307 - RNA, 1410 nt, Artificial Sequence; identical to SEQ ID NO: 178300
  derived and/or modified sequence opt4 from neuraminidase__InfluenzaA__AIM56626

SEQ ID NO: 178308 - RNA, 1410 nt, Artificial Sequence; identical to SEQ ID NO: 178245
  derived and/or modified sequence opt4 from neuraminidase__InfluenzaA__AIM56637

SEQ ID NO: 178309 - RNA, 1410 nt, Artificial Sequence; identical to SEQ ID NO: 178251
  derived and/or modified sequence opt4 from neuraminidase__InfluenzaA__AIM56648

SEQ ID NO: 178310 - RNA, 1410 nt, Artificial Sequence
  derived and/or modified sequence opt4 from neuraminidase__InfluenzaA__AIM56659
augaaccccaaccagaagaucaucaccaucggcagcgugugcaugaccaucggcauggccaaccugauccugcagaucggcaacaucaucagcaucugggugagccacagcauccagcugggcaaccagagccacaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaucggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaagaccaucuggaccagcggcagcagcaucagcuucugcggcgugaacagcgacaccgugggcuggagcuggcccgacggcgccgagcugcccuucaccaucgacaaguga

SEQ ID NO: 178311 - RNA, 1410 nt, Artificial Sequence
  derived and/or modified sequence opt4 from neuraminidase__InfluenzaA__AIM56670
augaaccccaaccagaagaucaucaccaucggcagcgugugcaugaccaucggcauggccaaccugauccugcagaucggcaacaccaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178312 - RNA, 1410 nt, Artificial Sequence; identical to SEQ ID NO: 178263
  derived and/or modified sequence opt4 from neuraminidase__InfluenzaA__AIM56703

SEQ ID NO: 178313 - RNA, 1410 nt, Artificial Sequence
  derived and/or modified sequence opt4 from neuraminidase__InfluenzaA__AIM56714
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugcccagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178314 - RNA, 1410 nt, Artificial Sequence
  derived and/or modified sequence opt4 from neuraminidase__InfluenzaA__AIM56725
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgaggugaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178315 - RNA, 1410 nt, Artificial Sequence; identical to SEQ ID NO: 178263
  derived and/or modified sequence opt4 from neuraminidase__InfluenzaA__AIM56736

SEQ ID NO: 178316 - RNA, 1410 nt, Artificial Sequence
  derived and/or modified sequence opt4 from neuraminidase__InfluenzaA__AIM56747
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcagccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178317 - RNA, 1410 nt, Artificial Sequence; identical to SEQ ID NO: 178300
  derived and/or modified sequence opt4 from neuraminidase__InfluenzaA__AIM56758

SEQ ID NO: 178318 - RNA, 1410 nt, Artificial Sequence; identical to SEQ ID NO: 178263
  derived and/or modified sequence opt4 from neuraminidase__InfluenzaA__AIM56769

SEQ ID NO: 178319 - RNA, 1410 nt, Artificial Sequence
  derived and/or modified sequence opt4 from neuraminidase__InfluenzaA__AIM56780
augaaccccaaccagaagaucaucaccaucggcagcgugugcaugaccaucggcauggccaaccugauccugcagaucggcaacaucaucagcaucugggugagccacagcauccagcugggcaaccagagccagaucggcaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcauccacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178320 - RNA, 1410 nt, Artificial Sequence
  derived and/or modified sequence opt4 from neuraminidase__InfluenzaA__AIM56791
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaaggaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178321 - RNA, 1410 nt, Artificial Sequence
  derived and/or modified sequence opt4 from neuraminidase__InfluenzaA__AIM56813
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcaaguucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178322 - RNA, 1410 nt, Artificial Sequence
  derived and/or modified sequence opt4 from neuraminidase__InfluenzaA__AIM56824
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugcccagcaacggcgccaacggcgugaagggcuucagcuucaaguacagcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178323 - RNA, 1398 nt, Artificial Sequence
  derived and/or modified sequence opt4 from neuraminidase__InfluenzaA__AIN76385
augaaccccaaccagaagauccugugcaccagcgccaccgccaucaucaucggcgccaucgccgugcugaucggcaucgccaaccugggccugaacaucggccugcaccugaagcccggcugcaacugcagccacagccagcccggcaccaccaacaccagccagaccaucaucaacaacuacuacaacgagaccaacaucaccaacauccagauggaggagagaaccagcagaaacuucaacagccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcaucugccccaucguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcaaggacaacuggcagggcagcaacagacccgugauccagaucgaccccguggccaugacccacaccagccaguacaucugcagccccgugcugaccgacacccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccagaaucgaguacuuccuguga

SEQ ID NO: 178324 - RNA, 1410 nt, Artificial Sequence; identical to SEQ ID NO: 166607
  derived and/or modified sequence opt4 from neuraminidase__InfluenzaA__AIP93105

SEQ ID NO: 178325 - RNA, 1410 nt, Artificial Sequence
  derived and/or modified sequence opt4 from neuraminidase__InfluenzaA__AIP93117
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 178326 - RNA, 1410 nt, Artificial Sequence
  derived and/or modified sequence opt4 from neuraminidase__InfluenzaA__AIR93973
augaaccccaaccagaagaucaucaccaucggcagcgugugcaugaccaucggcauggccaaccugauccugcagaucggcaacaucaucagcaucuggaucagccacagcauccagcugggcagcagaaaccagaucgaggccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcaacaccgugggcuggagcuggcccgacggcgccgagcugcccuucaccaucgacaaguga

SEQ ID NO: 178327 - RNA, 1410 nt, Artificial Sequence
  derived and/or modified sequence opt4 from neuraminidase__InfluenzaA__AIR93984
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaucaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccugggcugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178328 - RNA, 1410 nt, Artificial Sequence
  derived and/or modified sequence opt4 from neuraminidase__InfluenzaA__AIR93995
augaaccccaaccagaagaucaucaucaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugcccgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggaagaacaacauccugagaacccaggagagcgagugcgugugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucaucggcaucaacgaguggagcggcuacagcggcagcuucgugcagcaccccgagcugaccggcauggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178329 - RNA, 1401 nt, Artificial Sequence
  derived and/or modified sequence opt4 from neuraminidase__InfluenzaA__AIR94118
augaaccccaaccagaagaucaucgccaucggcagcgugagccugaucaucgccaucaucugccugcugaugcagaucgccauccugaccaccaccaugacccugcacuucagacagaacgagugcaacaacagcagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacaacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucaaggagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcaaggaccccaacagcgagagaggcgcccccggcgugaagggcugggccuucgacgacggcaacgacguguggaugggcagaaccaucaagaacggcagcagaagcggcuacgagaccuucagaguggugaacggcuggaccguggccaacagcaagagccaggugaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 178330 - RNA, 1410 nt, Artificial Sequence
  derived and/or modified sequence opt4 from neuraminidase__InfluenzaA__AIT38335
augaaccccaaccagaagaucaucaccaucggcagcgugagccugaccaucgccaccaucugcuuccugaugcagaucgccauccuggugaccaccgugacccugcacuucaagcaguacgagugcaacagcccccccaccaaccaggugaugcugugcgagcccaccaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcauccccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucgugagcuggagcaagagaauccugagaacccaggagagcgagugcgugugcaucgacggcaccugcaccguggugaugaccgacggcagcgccagcggcagagccgacaccagaauccuguucaucaaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugaaggacuacagcaucaacagcagcuacgugugcagcggccuggugggcgacacccccagaaagaacgacagcuucagcagcagcuacugccugaaccccaacaacgaggagggcggccacggcgugaagggcugggccuucgacgacggcgacgacguguggaugggcagaaccaucaacgagaagcugagaagcggcuacgagaccuucaaggugaucaagggcuggagcaagcccaacagcaagcugcagaucaacagacaggugaucguggacagaggcaacagaagcggcuacagcggcaucuucagcguggagggcaagggcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccaacaucaaccugaugcccaucuga

SEQ ID NO: 178331 - RNA, 1410 nt, Artificial Sequence
  derived and/or modified sequence opt4 from neuraminidase__InfluenzaA__AIT38346
augaaccccaaccagaagaucaucaccaucggcagcaucagccugaccaucgccaccaucugcuuccugcugcagguggccauccuggugaccaccgugacccugcacuucaagcaguucgagugcaaccccacccccaacaaccaggugaugcugugcgagcccaccgugaucgagagaaacaucaccaagaucguguaccugaccaacaccaccguggagaaggagaucugccccaagcccgccgaguacagaaacuggagcaagccccagugcaagaucaccggcuucgcccccuucagcaaggacaacagcaucagacugagcgccggcggcgacaucugggugaccagagagcccuacgugagcugcgcccccaacaagugcuaccaguucgcccugggccagggcaccacccugaacaacagacacagcaacgacaccgugcacgacagaacccccuacagaacccugcugaugaacgagcugggcauccccuuccaccugggcaccaagcaggugugcaucgccuggagcagcagcagcugccacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucaaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacgugagagacuacagcaucgugagcagcuacgugugcagcggccuggugggcgacacccccagaaagaacgacagcuucagcagcagccacugccugaaccccaacaacgaggagggcggccacggcgugaagggcugggccuucgacgacggcgacgacguguggaugggcagaaccaucagcgagaagcugagaagcggcuacgagaccuucaaggugaucaagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 178332 - RNA, 1410 nt, Artificial Sequence
  derived and/or modified sequence opt4 from neuraminidase__InfluenzaA__AIT38361
augaaccccaaccagaagaucaucaccaucggcagcaucagccugaccaucgccaccaucugcuuccugaugcagguggccauccuggugaccaccgugacccugcacuucaagcaguacgagugcaacagcacccccaacaaccaggugaugcugugcgagcccaccgugaucgagagaaacaucaccaagaucguguaccugaccaacaccaccguggugaaggaggugugccccaagcccgccgaguacagaaacuggagcaagccccagugcaagaucaccggcuucgcccccuucagcaaggacaacagcaucagacugagcgccggcggcgacaucugggugaccagagagcccuacgugagcugcgcccccaacaagugcuaccaguucgcccugggccagggcaccacccugaacaacagacacagcaacgacaccgugcacgacagaacccccuacagaacccugcugaugaacgagcugggcauccccuuccaccugggcaccaagcaggugugcaucgccuggagcagcagcagcugcuacgacggcaaggccuggcugcacgugugcgugaccggccacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucaaggagggcaagaucauccacaucagccagcugagcggcagcgcccagcacguggaggagugcagcugcuaccccagauaccccggcgugagaugcgugugcagagacaacuggaagggcagcaacagacccaucguggacaucaacaugagagacuacagcaucgugagcagcuacgugugcagcggccuggugggcgacacccccagagagaacgacagcuucagcagcagccacugccugaaccccaacaacgaggagggcggccacggcgugaagggcugggccuucgacgacggcgacgacguguggaugggcagaaccaucagcgagaagcugagaagcggcuacgagaccuucaaggugaucaagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 178333 - RNA, 1410 nt, Artificial Sequence
  derived and/or modified sequence opt4 from neuraminidase__InfluenzaA__AIT38375
augaaccccaaccagaagaucaucaccaucggcagcgugugcaugaccaucggcauggugaaccugauccugcagaucggcaacaucaucagcaucuggaucagccacagcauccagcugggcaaccagaaccagaucgagaucugcaaccagagcgugaucaccuacgagaacaacaccugggugaaccagaccuacgugaacaucagcaacaccaacuucgccgccggccagagcguggugcccgugaagcuggccggcaacagcagccugugcagcgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178334 - RNA, 1410 nt, Artificial Sequence
  derived and/or modified sequence opt4 from neuraminidase__InfluenzaA__AIT93148
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178335 - RNA, 1410 nt, Artificial Sequence; identical to SEQ ID NO: 171160
  derived and/or modified sequence opt4 from neuraminidase__InfluenzaA__AIU39701

SEQ ID NO: 178336 - RNA, 1410 nt, Artificial Sequence; identical to SEQ ID NO: 169258
  derived and/or modified sequence opt4 from neuraminidase__InfluenzaA__AIU39703

SEQ ID NO: 178337 - RNA, 1410 nt, Artificial Sequence
  derived and/or modified sequence opt4 from neuraminidase__InfluenzaA__AIU39705
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaacaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178338 - RNA, 1413 nt, Artificial Sequence
  derived and/or modified sequence opt4 from neuraminidase__InfluenzaA__AIU46611
augaaccccaaccagaagaucaccugcaucagcgccaccggcaugacccugagcguggugagcaugcugaucggcaucgccaaccugggccugaacaucggccugcacuacaaggugggcgacagcaccaacaucaacauccccaacaugaacgagaccagccccaccaccaccaucaucaacaaccacccccagaacaacuucaccaacaucaccaacaucaucgugaccagaaacgaggagggccaccugcugaaccugaccaagccccugugcgaggugaacagcuggcacauccugagcaaggacaacgccaucagaaucggcgaggacgcccacaucaucgugaccagagagcccuaccugagcugcgacccccagggcugcagaauguucgcccugagccagggcaccacccugagaggcaagcacgccaacggcaccauccacgacagaagccccuucagagcccuggugagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagaucaagaagaucgaggagcugaagggcgacgcccagcacaucgaggagugcagcugcuacggcgccagcgagaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaacugcgaggcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcaaggagagacugggcagcuggagcuggcacgacggcgccgagaucaucuacuucaaguga

SEQ ID NO: 178339 - RNA, 1410 nt, Artificial Sequence
  derived and/or modified sequence opt4 from neuraminidase__InfluenzaA__AIV09221
augaaccccaaccagaagaucaucaccaucggcagcgugugcaugaccaucggcauggccaaccugauccugcagaucggcaacaucaccagcaucuggaucagccacagcauccagaucggcaacagaaaccagaucgaggccugcaaccagagcgugaucaccuacgagaacaacaccugggugaaccagaccuacgugaacaucagcaacaccaacuucgccgugggccagagcguggugcccgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugcccagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcaacaccguggacuggagcuggcccgacggcgccgagcugcccuucaccaucgacaaguga

SEQ ID NO: 178340 - RNA, 1410 nt, Artificial Sequence
  derived and/or modified sequence opt4 from neuraminidase__InfluenzaA__AIW60703
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuacccccaguacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagaacugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 178341 - RNA, 1410 nt, Artificial Sequence
  derived and/or modified sequence opt4 from neuraminidase__InfluenzaA__AIW60704
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaucgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuacccccaguacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagaacugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 178342 - RNA, 1410 nt, Artificial Sequence
  derived and/or modified sequence opt4 from neuraminidase__InfluenzaA__AIW60705
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaaguucagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 178343 - RNA, 1410 nt, Artificial Sequence; identical to SEQ ID NO: 178342
  derived and/or modified sequence opt4 from neuraminidase__InfluenzaA__AIW60706

SEQ ID NO: 178344 - RNA, 1410 nt, Artificial Sequence
  derived and/or modified sequence opt4 from neuraminidase__InfluenzaA__AIW60708
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagcagcggcuacagcggcaucuucagcguggagggcaagagcugcaucaacagaugcuucuacguggagcugaucagaggcagaaagcaggagaccgaggugugguggaccagcaacagcaucguggugcugugcggcaccagcggcaccuacggcaccggcagcuggcccgacggcgccgacaucaaccugaugcccaucuga

SEQ ID NO: 178345 - RNA, 1410 nt, Artificial Sequence
  derived and/or modified sequence opt4 from neuraminidase__InfluenzaA__AIW60710
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaccguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178346 - RNA, 1410 nt, Artificial Sequence; identical to SEQ ID NO: 167111
  derived and/or modified sequence opt4 from neuraminidase__InfluenzaA__AIW60711

SEQ ID NO: 178347 - RNA, 1410 nt, Artificial Sequence; identical to SEQ ID NO: 167111
  derived and/or modified sequence opt4 from neuraminidase__InfluenzaA__AIW60712

SEQ ID NO: 178348 - RNA, 1410 nt, Artificial Sequence
  derived and/or modified sequence opt4 from neuraminidase__InfluenzaA__AIW60713
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178349 - RNA, 1410 nt, Artificial Sequence
  derived and/or modified sequence opt4 from neuraminidase__InfluenzaA__AIW60714
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucgugggcagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178350 - RNA, 1410 nt, Artificial Sequence
  derived and/or modified sequence opt4 from neuraminidase__InfluenzaA__AIW60715
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178351 - RNA, 1410 nt, Artificial Sequence; identical to SEQ ID NO: 169031
  derived and/or modified sequence opt4 from neuraminidase__InfluenzaA__AIW60716

SEQ ID NO: 178352 - RNA, 1410 nt, Artificial Sequence
  derived and/or modified sequence opt4 from neuraminidase__InfluenzaA__AIY54970
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgaccuguggaugggcagaaccaucagccagaaccugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178353 - RNA, 1410 nt, Artificial Sequence
  derived and/or modified sequence opt4 from neuraminidase__InfluenzaA__AIY54974
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugagcgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaagguggacagaggcaacagaagcggcuacagcggcaucuucagcguggagggcaagagcugcaucaacagaugcuucuacguggagcugaucagaggcagaaaggaggagaccaaggugcuguggaccagcaacagcaucgugguguucugcggcaccagcggcaccuacggcaccggcagcuggcccgacggcgccgacaucaaccugaugcccaucuga

SEQ ID NO: 178354 - RNA, 1410 nt, Artificial Sequence
  derived and/or modified sequence opt4 from neuraminidase__InfluenzaA__AIY54982
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaaguucagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178355 - RNA, 1410 nt, Artificial Sequence
  derived and/or modified sequence opt4 from neuraminidase__InfluenzaA__AIY54990
augaaccccaaccagaagaucaucaccaucggcagcgugagccugaccaucagcaccaucugcuucuucaugcagaucgccauccugaucaccaccgugacccugcacuucaagcaguacgaguucagcagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagauacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178356 - RNA, 1401 nt, Artificial Sequence
  derived and/or modified sequence opt4 from neuraminidase__InfluenzaA__AJD78177
augaaccccaaccagaagaucaucgccaucggcagcgugagccugaucaucgccgugaucugccugcugaugcagaucgccauccugaccaccaccaugacccugcacuucaugcagaacgagugcagcaaccccagcaacaaccaggugaugcccugcgagcccaucaucaucgagagaaacaccgugcaccugaacaacaccaccaucgagagagagaucugccccaaggccgccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 178357 - RNA, 1401 nt, Artificial Sequence
  derived and/or modified sequence opt4 from neuraminidase__InfluenzaA__AJD78189
augaaccccaaccagaagaucaucgccaucggcagcgugagccugaucaucgccaucaucugccugcugaugcagaucgccauccugaccaccaccaugacccugcacuucagacagaacgagugcaacaacagcagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccagccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacaacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcaaggaccccaacagcgagagaggcgcccccggcgugaagggcugggccuucgacgacggcaacgacguguggaugggcagaaccaucaagaacggcagcagaagcggcuacgagaccuucagagugcugaacggcuggaccguggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 178358 - RNA, 1401 nt, Artificial Sequence
  derived and/or modified sequence opt4 from neuraminidase__InfluenzaA__AJD78201
augaaccccaaccagaagaucaccgccaucggcagcgugagccugaucaucgccaucaucugccugcugaugcagaucgccauccugaccaccaccaugacccugcacuucagacagaaggagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccugaucaccggcuucgcccccuucagcaaggacaacagcaucagacugagcgccggcggcgacaucugggugaccagagagcccuacgugagcugcagccccgacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagagugcuguucaucagagagggcaagaucaucaacaucagaccccugagcggcagcgcccagcacguggaggagugcagcugcuaccccagauaccccgaggugagaugcgugugcagagacaacuggaagggcagcaacagacccaucaucuacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagagugaucaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 178359 - RNA, 1401 nt, Artificial Sequence
  derived and/or modified sequence opt4 from neuraminidase__InfluenzaA__AJD78213
augaaccccaaccagaagaucaccgccaucggcagcgugagccugaucaucgccaucaucugccuguucaugcagaucgccauccugaccaccaccaugacccugcacuucagacagaaggagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccugaucaccggcuucgcccccuucagcaaggacaacagcaucagacugagcgccggcggcgacaucugggugaccagagagcccuacgugagcugcagccccgacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcguggccgacaccagagugcuguucaucagagagggcaagaucaucaacaucagaccccugagcggcagcgcccagcacguggaggagugcagcugcuaccccagauaccccgaggugagaugcgugugcagagacaacuggaagggcagcaacagacccaucaucuacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagagugaucaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 178360 - RNA, 1410 nt, Artificial Sequence; identical to SEQ ID NO: 175442
  derived and/or modified sequence opt4 from neuraminidase__InfluenzaA__AJI80140

SEQ ID NO: 178361 - RNA, 1410 nt, Artificial Sequence; identical to SEQ ID NO: 175442
  derived and/or modified sequence opt4 from neuraminidase__InfluenzaA__AJI80152

SEQ ID NO: 178362 - RNA, 1410 nt, Artificial Sequence; identical to SEQ ID NO: 178218
  derived and/or modified sequence opt4 from neuraminidase__InfluenzaA__AJI80164

SEQ ID NO: 178363 - RNA, 1410 nt, Artificial Sequence; identical to SEQ ID NO: 178157
  derived and/or modified sequence opt4 from neuraminidase__InfluenzaA__AJI80175

SEQ ID NO: 178364 - RNA, 1410 nt, Artificial Sequence; identical to SEQ ID NO: 178157
  derived and/or modified sequence opt4 from neuraminidase__InfluenzaA__AJI80187

SEQ ID NO: 178365 - RNA, 1410 nt, Artificial Sequence; identical to SEQ ID NO: 178157
  derived and/or modified sequence opt4 from neuraminidase__InfluenzaA__AJI80199

SEQ ID NO: 178366 - RNA, 1410 nt, Artificial Sequence; identical to SEQ ID NO: 178157
  derived and/or modified sequence opt4 from neuraminidase__InfluenzaA__AJI80211

SEQ ID NO: 178367 - RNA, 1410 nt, Artificial Sequence; identical to SEQ ID NO: 176391
  derived and/or modified sequence opt4 from neuraminidase__InfluenzaA__AJI80223

SEQ ID NO: 178368 - RNA, 1410 nt, Artificial Sequence; identical to SEQ ID NO: 178157
  derived and/or modified sequence opt4 from neuraminidase__InfluenzaA__AJI80235

SEQ ID NO: 178369 - RNA, 1410 nt, Artificial Sequence; identical to SEQ ID NO: 176391
  derived and/or modified sequence opt4 from neuraminidase__InfluenzaA__AJI80247

SEQ ID NO: 178370 - RNA, 1410 nt, Artificial Sequence; identical to SEQ ID NO: 178176
  derived and/or modified sequence opt4 from neuraminidase__InfluenzaA__AJI80259

SEQ ID NO: 178371 - RNA, 1410 nt, Artificial Sequence; identical to SEQ ID NO: 174666
  derived and/or modified sequence opt4 from neuraminidase__InfluenzaA__AJI80271

SEQ ID NO: 178372 - RNA, 1410 nt, Artificial Sequence; identical to SEQ ID NO: 178157
  derived and/or modified sequence opt4 from neuraminidase__InfluenzaA__AJI80283

SEQ ID NO: 178373 - RNA, 1410 nt, Artificial Sequence
  derived and/or modified sequence opt4 from neuraminidase__InfluenzaA__AJI80306
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugcuggacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacaagcaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178374 - RNA, 1410 nt, Artificial Sequence
  derived and/or modified sequence opt4 from neuraminidase__InfluenzaA__AJI80318
augaaccccaaccagaagaucaucaccaucggcagcgugugcaugaccaucggcauggccaaccugauccugcagaucggcaacaucaucagcaucuggaucagccacagcauccagcugggcaaccagagccagaucgaggccugcaaccagaacgugaucaccuacgagaacaacaccugggugaaccagaccuacgugaacaucagcaacaccaacuucgccaccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178375 - RNA, 1410 nt, Artificial Sequence
  derived and/or modified sequence opt4 from neuraminidase__InfluenzaA__AJI80329
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178376 - RNA, 1410 nt, Artificial Sequence
  derived and/or modified sequence opt4 from neuraminidase__InfluenzaA__AJI80340
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggaagaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuacuacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178377 - RNA, 1410 nt, Artificial Sequence; identical to SEQ ID NO: 174666
  derived and/or modified sequence opt4 from neuraminidase__InfluenzaA__AJI80351

SEQ ID NO: 178378 - RNA, 1410 nt, Artificial Sequence
  derived and/or modified sequence opt4 from neuraminidase__InfluenzaA__AJI80363
augaaccccaaccagaagaucaucaccaucggcagcgugagccugaccaucagcaccaucugcuucuucaugcagaucgccauccugaucaccaccgugacccugcacuucaagcaguacgaguucaacagccugcccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgccagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcggcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178379 - RNA, 1410 nt, Artificial Sequence
  derived and/or modified sequence opt4 from neuraminidase__InfluenzaA__AJI80375
augaaccccaaccagaagaucaucaccaucggcagcgugagccugaccaucagcaccaucugccuguucaugcagaucgccauccugaucaccaccgugacccugcacuucaagcagcacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178380 - RNA, 1410 nt, Artificial Sequence; identical to SEQ ID NO: 178196
  derived and/or modified sequence opt4 from neuraminidase__InfluenzaA__AJI80387

SEQ ID NO: 178381 - RNA, 1410 nt, Artificial Sequence; identical to SEQ ID NO: 178196
  derived and/or modified sequence opt4 from neuraminidase__InfluenzaA__AJI80398

SEQ ID NO: 178382 - RNA, 1410 nt, Artificial Sequence; identical to SEQ ID NO: 178196
  derived and/or modified sequence opt4 from neuraminidase__InfluenzaA__AJI80409

SEQ ID NO: 178383 - RNA, 1410 nt, Artificial Sequence; identical to SEQ ID NO: 178196
  derived and/or modified sequence opt4 from neuraminidase__InfluenzaA__AJI80420

SEQ ID NO: 178384 - RNA, 1410 nt, Artificial Sequence; identical to SEQ ID NO: 178196
  derived and/or modified sequence opt4 from neuraminidase__InfluenzaA__AJI80431

SEQ ID NO: 178385 - RNA, 1410 nt, Artificial Sequence; identical to SEQ ID NO: 178191
  derived and/or modified sequence opt4 from neuraminidase__InfluenzaA__AJI80442

SEQ ID NO: 178386 - RNA, 1410 nt, Artificial Sequence; identical to SEQ ID NO: 178196
  derived and/or modified sequence opt4 from neuraminidase__InfluenzaA__AJI80454

SEQ ID NO: 178387 - RNA, 1410 nt, Artificial Sequence; identical to SEQ ID NO: 178191
  derived and/or modified sequence opt4 from neuraminidase__InfluenzaA__AJI80465

SEQ ID NO: 178388 - RNA, 1410 nt, Artificial Sequence; identical to SEQ ID NO: 178196
  derived and/or modified sequence opt4 from neuraminidase__InfluenzaA__AJI80477

SEQ ID NO: 178389 - RNA, 1410 nt, Artificial Sequence; identical to SEQ ID NO: 178196
  derived and/or modified sequence opt4 from neuraminidase__InfluenzaA__AJI80488

SEQ ID NO: 178390 - RNA, 1410 nt, Artificial Sequence; identical to SEQ ID NO: 178218
  derived and/or modified sequence opt4 from neuraminidase__InfluenzaA__AJI80499

SEQ ID NO: 178391 - RNA, 1410 nt, Artificial Sequence; identical to SEQ ID NO: 178196
  derived and/or modified sequence opt4 from neuraminidase__InfluenzaA__AJI80510

SEQ ID NO: 178392 - RNA, 1410 nt, Artificial Sequence; identical to SEQ ID NO: 178218
  derived and/or modified sequence opt4 from neuraminidase__InfluenzaA__AJI80521

SEQ ID NO: 178393 - RNA, 1410 nt, Artificial Sequence
  derived and/or modified sequence opt4 from neuraminidase__InfluenzaA__AJJ98767
augaaccccaaccagaagaucaucaccaucggcagcgugagccugaccaucagcaccaucugcuucuucaugcagaucgccauccugaucaccaccgugacccugcacuucaagcaguacgaguucaacagccccagcaacaaccaggugaugcugugcgagcccaccaucaucgagagaaacaucaccgagaucguguaccugaccaacaccaccaucgagaaggagaagugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcgacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 178394 - RNA, 1410 nt, Artificial Sequence
  derived and/or modified sequence opt4 from neuraminidase__InfluenzaA__AJJ98779
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggaccaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178395 - RNA, 1410 nt, Artificial Sequence; identical to SEQ ID NO: 174666
  derived and/or modified sequence opt4 from neuraminidase__InfluenzaA__AJJ98791

SEQ ID NO: 178396 - RNA, 1410 nt, Artificial Sequence
  derived and/or modified sequence opt4 from neuraminidase__InfluenzaA__AJJ98803
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaaggugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178397 - RNA, 1410 nt, Artificial Sequence; identical to SEQ ID NO: 174666
  derived and/or modified sequence opt4 from neuraminidase__InfluenzaA__AJJ98815

SEQ ID NO: 178398 - RNA, 1410 nt, Artificial Sequence
  derived and/or modified sequence opt4 from neuraminidase__InfluenzaA__AJJ98827
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacaacaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178399 - RNA, 1410 nt, Artificial Sequence; identical to SEQ ID NO: 173663
  derived and/or modified sequence opt4 from neuraminidase__InfluenzaA__AJJ98839

SEQ ID NO: 178400 - RNA, 1410 nt, Artificial Sequence; identical to SEQ ID NO: 172038
  derived and/or modified sequence opt4 from neuraminidase__InfluenzaA__AJJ98851

SEQ ID NO: 178401 - RNA, 1410 nt, Artificial Sequence
  derived and/or modified sequence opt4 from neuraminidase__InfluenzaA__AJJ98863
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagagagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcaucugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaugaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178402 - RNA, 1410 nt, Artificial Sequence
  derived and/or modified sequence opt4 from neuraminidase__InfluenzaA__AJJ98875
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178403 - RNA, 1410 nt, Artificial Sequence
  derived and/or modified sequence opt4 from neuraminidase__InfluenzaA__AJJ98887
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgacgugcuguggaccagcaacagcaucgugguguucugcggcaccagcggcaccuacggcaccggcagcuggcccgacggcgccgacaucaaccugaugcccaucuga

SEQ ID NO: 178404 - RNA, 1410 nt, Artificial Sequence
  derived and/or modified sequence opt4 from neuraminidase__InfluenzaA__AJJ98899
augaaccccaaccagaagaucaucaccaucggcagcgugagccugaccaucagcaccaucugcuucuucaugcagaccgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178405 - RNA, 1410 nt, Artificial Sequence; identical to SEQ ID NO: 174666
  derived and/or modified sequence opt4 from neuraminidase__InfluenzaA__AJJ98911

SEQ ID NO: 178406 - RNA, 1410 nt, Artificial Sequence; identical to SEQ ID NO: 175442
  derived and/or modified sequence opt4 from neuraminidase__InfluenzaA__AJJ98923

SEQ ID NO: 178407 - RNA, 1410 nt, Artificial Sequence
  derived and/or modified sequence opt4 from neuraminidase__InfluenzaA__AJJ98935
augaaccccaaccagaagaucaucaccaucggcagcgugagccugaccaucagcaccaucugcuucuucaugcagaucgccauccugaucaccaccgugacccugcacuucaagagauacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178408 - RNA, 1410 nt, Artificial Sequence
  derived and/or modified sequence opt4 from neuraminidase__InfluenzaA__AJJ98947
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugacccugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcaacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178409 - RNA, 1410 nt, Artificial Sequence
  derived and/or modified sequence opt4 from neuraminidase__InfluenzaA__AJJ98971
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178410 - RNA, 1410 nt, Artificial Sequence
  derived and/or modified sequence opt4 from neuraminidase__InfluenzaA__AJJ98995
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178411 - RNA, 1410 nt, Artificial Sequence; identical to SEQ ID NO: 173663
  derived and/or modified sequence opt4 from neuraminidase__InfluenzaA__AJJ99007

SEQ ID NO: 178412 - RNA, 1410 nt, Artificial Sequence
  derived and/or modified sequence opt4 from neuraminidase__InfluenzaA__AJJ99019
augaaccccaaccagaagaucaucaccaucggcagcgugagccugaccaucagcaccaucugcuucuucaugcagaccgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcaacuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagauucggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178413 - RNA, 1410 nt, Artificial Sequence
  derived and/or modified sequence opt4 from neuraminidase__InfluenzaA__AJJ99031
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccaccaucaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178414 - RNA, 1410 nt, Artificial Sequence
  derived and/or modified sequence opt4 from neuraminidase__InfluenzaA__AJJ99043
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggagaggcagcaacagacccaucguggacaucaacaugaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagagcagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178415 - RNA, 1410 nt, Artificial Sequence
  derived and/or modified sequence opt4 from neuraminidase__InfluenzaA__AJJ99067
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaggcagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178416 - RNA, 1410 nt, Artificial Sequence
  derived and/or modified sequence opt4 from neuraminidase__InfluenzaA__AJJ99079
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178417 - RNA, 1410 nt, Artificial Sequence
  derived and/or modified sequence opt4 from neuraminidase__InfluenzaA__AJJ99091
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgaccuguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178418 - RNA, 1410 nt, Artificial Sequence
  derived and/or modified sequence opt4 from neuraminidase__InfluenzaA__AJJ99103
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaugaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaagcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178419 - RNA, 1410 nt, Artificial Sequence; identical to SEQ ID NO: 177885
  derived and/or modified sequence opt4 from neuraminidase__InfluenzaA__AJJ99115

SEQ ID NO: 178420 - RNA, 1410 nt, Artificial Sequence; identical to SEQ ID NO: 176805
  derived and/or modified sequence opt4 from neuraminidase__InfluenzaA__AJJ99127

SEQ ID NO: 178421 - RNA, 1410 nt, Artificial Sequence; identical to SEQ ID NO: 178093
  derived and/or modified sequence opt4 from neuraminidase__InfluenzaA__AJJ99139

SEQ ID NO: 178422 - RNA, 1410 nt, Artificial Sequence
  derived and/or modified sequence opt4 from neuraminidase__InfluenzaA__AJJ99151
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178423 - RNA, 1410 nt, Artificial Sequence; identical to SEQ ID NO: 169119
  derived and/or modified sequence opt4 from neuraminidase__InfluenzaA__AJJ99163

SEQ ID NO: 178424 - RNA, 1410 nt, Artificial Sequence
  derived and/or modified sequence opt4 from neuraminidase__InfluenzaA__AJJ99175
augaaccccaaccagaagaucaucaccaucggcagcgugagccugaccaucagcaccaucugccuguucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcaccgacaucaaccugaugcccaucuga

SEQ ID NO: 178425 - RNA, 1410 nt, Artificial Sequence
  derived and/or modified sequence opt4 from neuraminidase__InfluenzaA__AJJ99199
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178426 - RNA, 1410 nt, Artificial Sequence; identical to SEQ ID NO: 169263
  derived and/or modified sequence opt4 from neuraminidase__InfluenzaA__AJJ99211

SEQ ID NO: 178427 - RNA, 1410 nt, Artificial Sequence
  derived and/or modified sequence opt4 from neuraminidase__InfluenzaA__AJJ99223
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacgugugggugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178428 - RNA, 1410 nt, Artificial Sequence
  derived and/or modified sequence opt4 from neuraminidase__InfluenzaA__AJJ99235
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcgaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucgagggcuggagcaaccccaagagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178429 - RNA, 1410 nt, Artificial Sequence
  derived and/or modified sequence opt4 from neuraminidase__InfluenzaA__AJJ99246
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagaacgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugccugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcagcggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178430 - RNA, 1410 nt, Artificial Sequence
  derived and/or modified sequence opt4 from neuraminidase__InfluenzaA__AJJ99257
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugcccagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaccaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 178431 - RNA, 1413 nt, Artificial Sequence; identical to SEQ ID NO: 169152
  derived and/or modified sequence opt4 from neuraminidase__InfluenzaA__AJJ99269

SEQ ID NO: 178432 - RNA, 1410 nt, Artificial Sequence; identical to SEQ ID NO: 173478
  derived and/or modified sequence opt4 from neuraminidase__InfluenzaA__AJJ99280

SEQ ID NO: 178433 - RNA, 1410 nt, Artificial Sequence; identical to SEQ ID NO: 173229
  derived and/or modified sequence opt4 from neuraminidase__InfluenzaA__AJJ99291

SEQ ID NO: 178434 - RNA, 1413 nt, Artificial Sequence
  derived and/or modified sequence opt4 from neuraminidase__InfluenzaA__AJJ99303
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcauggagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178435 - RNA, 1410 nt, Artificial Sequence
  derived and/or modified sequence opt4 from neuraminidase__InfluenzaA__AJJ99314
augaaccccaaccagaagaucaucaccaucggcagcgccugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178436 - RNA, 1413 nt, Artificial Sequence
  derived and/or modified sequence opt4 from neuraminidase__InfluenzaA__AJJ99326
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggccugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178437 - RNA, 1410 nt, Artificial Sequence; identical to SEQ ID NO: 170902
  derived and/or modified sequence opt4 from neuraminidase__InfluenzaA__AJJ99337

SEQ ID NO: 178438 - RNA, 1410 nt, Artificial Sequence; identical to SEQ ID NO: 170365
  derived and/or modified sequence opt4 from neuraminidase__InfluenzaA__AJJ99348

SEQ ID NO: 178439 - RNA, 1410 nt, Artificial Sequence; identical to SEQ ID NO: 169258
  derived and/or modified sequence opt4 from neuraminidase__InfluenzaA__AJJ99359

SEQ ID NO: 178440 - RNA, 1410 nt, Artificial Sequence
  derived and/or modified sequence opt4 from neuraminidase__InfluenzaA__AJJ99370
augaaccccaaccagaagaucaucaccaucggcagcgugugcaugaucaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagcccccacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacagacaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178441 - RNA, 1410 nt, Artificial Sequence; identical to SEQ ID NO: 172777
  derived and/or modified sequence opt4 from neuraminidase__InfluenzaA__AJJ99381

SEQ ID NO: 178442 - RNA, 1410 nt, Artificial Sequence
  derived and/or modified sequence opt4 from neuraminidase__InfluenzaA__AJJ99392
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagccccaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccaagcugcccuucaccaucgacaaguga

SEQ ID NO: 178443 - RNA, 1410 nt, Artificial Sequence; identical to SEQ ID NO: 169258
  derived and/or modified sequence opt4 from neuraminidase__InfluenzaA__AJJ99403

SEQ ID NO: 178444 - RNA, 1413 nt, Artificial Sequence; identical to SEQ ID NO: 169981
  derived and/or modified sequence opt4 from neuraminidase__InfluenzaA__AJJ99415

SEQ ID NO: 178445 - RNA, 1413 nt, Artificial Sequence
  derived and/or modified sequence opt4 from neuraminidase__InfluenzaA__AJJ99427
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccguguacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcgacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaucaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178446 - RNA, 1413 nt, Artificial Sequence
  derived and/or modified sequence opt4 from neuraminidase__InfluenzaA__AJJ99439
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaccagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178447 - RNA, 1413 nt, Artificial Sequence
  derived and/or modified sequence opt4 from neuraminidase__InfluenzaA__AJJ99451
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacagaaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178448 - RNA, 1413 nt, Artificial Sequence; identical to SEQ ID NO: 169152
  derived and/or modified sequence opt4 from neuraminidase__InfluenzaA__AJJ99463

SEQ ID NO: 178449 - RNA, 1410 nt, Artificial Sequence
  derived and/or modified sequence opt4 from neuraminidase__InfluenzaA__AJJ99474
augaaccccaaccagaagaucaucaccaucggcagcgugugcaugaccaucggcaucgccaaccugauccugcagaucggcaacaucaucagcaucuggaucagccacagcauccagcugggcaaccagaaccagaucgagaccugcaaccagagcgugaucaucuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 178450 - RNA, 1410 nt, Artificial Sequence; identical to SEQ ID NO: 173229
  derived and/or modified sequence opt4 from neuraminidase__InfluenzaA__AJJ99496

SEQ ID NO: 178451 - RNA, 1410 nt, Artificial Sequence
  derived and/or modified sequence opt4 from neuraminidase__InfluenzaA__AJJ99507
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcgccaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacgacaacggcguguggaucggcagaaccaagagcaucagcagcagaaacggcuucgagaugaucugggaccccaacggcuggaccggcaccgacaacgacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178452 - RNA, 1410 nt, Artificial Sequence; identical to SEQ ID NO: 169258
  derived and/or modified sequence opt4 from neuraminidase__InfluenzaA__AJJ99518

SEQ ID NO: 178453 - RNA, 1410 nt, Artificial Sequence
  derived and/or modified sequence opt4 from neuraminidase__InfluenzaA__AJJ99529
augaaccccaaccagaagaucaucaccaucggcagcgugugcaugaccaucggcauggccaaccugauccugcaggugggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcuucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 178454 - RNA, 1410 nt, Artificial Sequence
  derived and/or modified sequence opt4 from neuraminidase__InfluenzaA__AJJ99540
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcaagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcaucuggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178455 - RNA, 1410 nt, Artificial Sequence
  derived and/or modified sequence opt4 from neuraminidase__InfluenzaA__AJJ99551
augaaccccaaccagaagaucaucaccaucggcagcgugugcaugaccaucggcauggccaaccugauccugcagaucggcaacaucaucagcaucuggaucagccacagcauccagcugggcaaccagagccagaccgagaccugcaaccagagcgugaucaccuacgagaacaacaccugggugaaccagaccuacgugaacaucagcaacaccaaccccgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcagccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178456 - RNA, 1410 nt, Artificial Sequence; identical to SEQ ID NO: 173245
  derived and/or modified sequence opt4 from neuraminidase__InfluenzaA__AJJ99562

SEQ ID NO: 178457 - RNA, 1410 nt, Artificial Sequence
  derived and/or modified sequence opt4 from neuraminidase__InfluenzaA__AJJ99573
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacguggugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178458 - RNA, 1410 nt, Artificial Sequence; identical to SEQ ID NO: 178435
  derived and/or modified sequence opt4 from neuraminidase__InfluenzaA__AJJ99584

SEQ ID NO: 178459 - RNA, 1410 nt, Artificial Sequence
  derived and/or modified sequence opt4 from neuraminidase__InfluenzaA__AJJ99595
augaaccccaaccagaagaucaucaccaucggcagcgugugcaugaccaucggcauggccaaccugaucuuccagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178460 - RNA, 1410 nt, Artificial Sequence
  derived and/or modified sequence opt4 from neuraminidase__InfluenzaA__AJJ99606
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcgugaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178461 - RNA, 1413 nt, Artificial Sequence; identical to SEQ ID NO: 169981
  derived and/or modified sequence opt4 from neuraminidase__InfluenzaA__AJJ99618

SEQ ID NO: 178462 - RNA, 1413 nt, Artificial Sequence
  derived and/or modified sequence opt4 from neuraminidase__InfluenzaA__AJJ99630
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcaugaagcagaacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178463 - RNA, 1413 nt, Artificial Sequence; identical to SEQ ID NO: 169981
  derived and/or modified sequence opt4 from neuraminidase__InfluenzaA__AJJ99642

SEQ ID NO: 178464 - RNA, 1413 nt, Artificial Sequence; identical to SEQ ID NO: 169981
  derived and/or modified sequence opt4 from neuraminidase__InfluenzaA__AJJ99654

SEQ ID NO: 178465 - RNA, 1413 nt, Artificial Sequence
  derived and/or modified sequence opt4 from neuraminidase__InfluenzaA__AJJ99666
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaacaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178466 - RNA, 1410 nt, Artificial Sequence
  derived and/or modified sequence opt4 from neuraminidase__InfluenzaA__AJJ99677
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaugaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 178467 - RNA, 1410 nt, Artificial Sequence
  derived and/or modified sequence opt4 from neuraminidase__InfluenzaA__AJJ99688
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 178468 - RNA, 1410 nt, Artificial Sequence
  derived and/or modified sequence opt4 from neuraminidase__InfluenzaA__AJJ99710
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcaagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178469 - RNA, 1410 nt, Artificial Sequence; identical to SEQ ID NO: 172777
  derived and/or modified sequence opt4 from neuraminidase__InfluenzaA__AJJ99721

SEQ ID NO: 178470 - RNA, 1410 nt, Artificial Sequence; identical to SEQ ID NO: 172777
  derived and/or modified sequence opt4 from neuraminidase__InfluenzaA__AJJ99732

SEQ ID NO: 178471 - RNA, 1410 nt, Artificial Sequence; identical to SEQ ID NO: 173477
  derived and/or modified sequence opt4 from neuraminidase__InfluenzaA__AJJ99743

SEQ ID NO: 178472 - RNA, 1410 nt, Artificial Sequence; identical to SEQ ID NO: 170811
  derived and/or modified sequence opt4 from neuraminidase__InfluenzaA__AJJ99754

SEQ ID NO: 178473 - RNA, 1410 nt, Artificial Sequence
  derived and/or modified sequence opt4 from neuraminidase__InfluenzaA__AJJ99765
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccaccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178474 - RNA, 1413 nt, Artificial Sequence
  derived and/or modified sequence opt4 from neuraminidase__InfluenzaA__AJJ99777
augaaccccaaccagaagaucaucaccaucggcagcaucagcaucgccaucggcaucaucagccugauccugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccgccguguggaccagcggcagcagcaucagcuucugcggcgugaacagcgacaccgccaacuggagcuggcccgacggcgccgagcugcccuucaccaucgacaaguga

SEQ ID NO: 178475 - RNA, 1410 nt, Artificial Sequence; identical to SEQ ID NO: 169258
  derived and/or modified sequence opt4 from neuraminidase__InfluenzaA__AJJ99788

SEQ ID NO: 178476 - RNA, 1413 nt, Artificial Sequence
  derived and/or modified sequence opt4 from neuraminidase__InfluenzaA__AJJ99800
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuucuacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaucaucgacaaguga

SEQ ID NO: 178477 - RNA, 1413 nt, Artificial Sequence; identical to SEQ ID NO: 169981
  derived and/or modified sequence opt4 from neuraminidase__InfluenzaA__AJJ99812

SEQ ID NO: 178478 - RNA, 1413 nt, Artificial Sequence
  derived and/or modified sequence opt4 from neuraminidase__InfluenzaA__AJJ99824
augaaccccaaccagaagaucaucaccaucggcagcaucagcaucgccaucggcaccaucagccugaugcugcagaucggcaacaucaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178479 - RNA, 1410 nt, Artificial Sequence; identical to SEQ ID NO: 178467
  derived and/or modified sequence opt4 from neuraminidase__InfluenzaA__AJJ99835

SEQ ID NO: 178480 - RNA, 1410 nt, Artificial Sequence; identical to SEQ ID NO: 172777
  derived and/or modified sequence opt4 from neuraminidase__InfluenzaA__AJJ99846

SEQ ID NO: 178481 - RNA, 1410 nt, Artificial Sequence; identical to SEQ ID NO: 172777
  derived and/or modified sequence opt4 from neuraminidase__InfluenzaA__AJJ99857

SEQ ID NO: 178482 - RNA, 1410 nt, Artificial Sequence
  derived and/or modified sequence opt4 from neuraminidase__InfluenzaA__AJJ99868
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgugaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcagaacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178483 - RNA, 1410 nt, Artificial Sequence; identical to SEQ ID NO: 171677
  derived and/or modified sequence opt4 from neuraminidase__InfluenzaA__AJJ99879

SEQ ID NO: 178484 - RNA, 1410 nt, Artificial Sequence; identical to SEQ ID NO: 169258
  derived and/or modified sequence opt4 from neuraminidase__InfluenzaA__AJJ99890

SEQ ID NO: 178485 - RNA, 1410 nt, Artificial Sequence
  derived and/or modified sequence opt4 from neuraminidase__InfluenzaA__AJJ99901
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcguggacagcggcaccgugggcuggagcuggcccgacggcgccgagcugcccuucaccaucgacaaguga

SEQ ID NO: 178486 - RNA, 1410 nt, Artificial Sequence
  derived and/or modified sequence opt4 from neuraminidase__InfluenzaA__AJJ99912
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcaagaucaccugcgugugcagagacaacuggcacggcagcaacagacccugggugagcuucaaccagaaccuggaguaccagaucggcuacaucugcagcggcaucuucggcgacaaccccagacccaaggacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178487 - RNA, 1410 nt, Artificial Sequence; identical to SEQ ID NO: 172777
  derived and/or modified sequence opt4 from neuraminidase__InfluenzaA__AJJ99923

SEQ ID NO: 178488 - RNA, 1410 nt, Artificial Sequence; identical to SEQ ID NO: 173229
  derived and/or modified sequence opt4 from neuraminidase__InfluenzaA__AJJ99934

SEQ ID NO: 178489 - RNA, 1410 nt, Artificial Sequence; identical to SEQ ID NO: 172777
  derived and/or modified sequence opt4 from neuraminidase__InfluenzaA__AJJ99945

SEQ ID NO: 178490 - RNA, 1410 nt, Artificial Sequence
  derived and/or modified sequence opt4 from neuraminidase__InfluenzaA__AJJ99956
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugcugagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178491 - RNA, 1410 nt, Artificial Sequence; identical to SEQ ID NO: 169258
  derived and/or modified sequence opt4 from neuraminidase__InfluenzaA__AJJ99967

SEQ ID NO: 178492 - RNA, 1413 nt, Artificial Sequence
  derived and/or modified sequence opt4 from neuraminidase__InfluenzaA__AJJ99991
augaaccccaaccagaagaucaucaccaucggcagcaucagcaucgccaucggcaucaucagccugaugcugcagaucggcaacaucaucagcaucugggccagccacagcauccagaccggcagccagaacaacaccggcaucugcaaccagagaaucaucaccuacgagaacugcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178493 - RNA, 1410 nt, Artificial Sequence; identical to SEQ ID NO: 178467
  derived and/or modified sequence opt4 from neuraminidase__InfluenzaA__AJK00003

SEQ ID NO: 178494 - RNA, 1410 nt, Artificial Sequence
  derived and/or modified sequence opt4 from neuraminidase__InfluenzaA__AJK00014
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcgugaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaccaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcaucaucagcuucugcggcgugaacagcgacaccgugggcuggagcuggcccgacggcgccgagcugcccuucaccaucgacaacuga

SEQ ID NO: 178495 - RNA, 1410 nt, Artificial Sequence
  derived and/or modified sequence opt4 from neuraminidase__InfluenzaA__AJK00025
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacagcuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcggcaccgugggcuggagcuggcccgacggcgccgagcugcccuucaccaucgacaaguga

SEQ ID NO: 178496 - RNA, 1410 nt, Artificial Sequence
  derived and/or modified sequence opt4 from neuraminidase__InfluenzaA__AJK00036
augaaccccaaccagaagaucaucaccaucggcagcgugugcaugaccaucggcauggccaaccugauccugcagaucggcaacaucaucagcaucuggaucagccacagcauccagcugggcaaccagagccagaucgagaccugcaaccagagcgugaucaccuacgagaacaacaccugggugaaccagaccuacgugaacaucagcaacaucaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178497 - RNA, 1410 nt, Artificial Sequence; identical to SEQ ID NO: 173477
  derived and/or modified sequence opt4 from neuraminidase__InfluenzaA__AJK00047

SEQ ID NO: 178498 - RNA, 1410 nt, Artificial Sequence; identical to SEQ ID NO: 173477
  derived and/or modified sequence opt4 from neuraminidase__InfluenzaA__AJK00058

SEQ ID NO: 178499 - RNA, 1410 nt, Artificial Sequence
  derived and/or modified sequence opt4 from neuraminidase__InfluenzaA__AJK00069
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacuucaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178500 - RNA, 1413 nt, Artificial Sequence; identical to SEQ ID NO: 169981
  derived and/or modified sequence opt4 from neuraminidase__InfluenzaA__AJK00081

SEQ ID NO: 178501 - RNA, 1413 nt, Artificial Sequence; identical to SEQ ID NO: 169152
  derived and/or modified sequence opt4 from neuraminidase__InfluenzaA__AJK00093

SEQ ID NO: 178502 - RNA, 1413 nt, Artificial Sequence
  derived and/or modified sequence opt4 from neuraminidase__InfluenzaA__AJK00105
augagccccaaccagaagaucaucaccaucggcagcaucagcaucgccaucggcaucaucagccugaugcugcagaucggcaacaccaucagcaucugggccagccacagcauccagaccggcagccagaacaacaccggcaucugcaaccagagaaucaucaccuacgagaacagcaccugggugaaccacaccuacgugaacaucaacaacaccaacgugguggccggcgaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacaaggccgccagcuacaagaucuucaagaucgagaagggcaaggugaccaagagcaucgagcugaacgcccccaacuuccacuacgaggagugcagcugcuaccccgacaccggcaucgugaugugcgugugcagagacaacuggcacggcagcaacagacccugggugagcuucaaccagaaccuggacuaccagaucggcuacaucugcagcggcguguucggcgacaaccccagacccgaggacggcgagggcagcugcaaccccgugaccguggacggcgccaacggcgugaagggcuucagcuacaaguacgacaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178503 - RNA, 1410 nt, Artificial Sequence; identical to SEQ ID NO: 171533
  derived and/or modified sequence opt4 from neuraminidase__InfluenzaA__AJK00116

SEQ ID NO: 178504 - RNA, 1410 nt, Artificial Sequence; identical to SEQ ID NO: 170365
  derived and/or modified sequence opt4 from neuraminidase__InfluenzaA__AJK00127

SEQ ID NO: 178505 - RNA, 1410 nt, Artificial Sequence; identical to SEQ ID NO: 169258
  derived and/or modified sequence opt4 from neuraminidase__InfluenzaA__AJK00138

SEQ ID NO: 178506 - RNA, 1350 nt, Artificial Sequence
  derived and/or modified sequence opt4 from neuraminidase__InfluenzaA__AJK00152
augaaccccaaccagaagaucaucaccaucggcagcaucugcauggugaccggcaucgugagccugaugcugcagaucggcaacaucaucagcaugugggugagccacagcauccagaccagaaaccagcaccagaccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugaucaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggagaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178507 - RNA, 1350 nt, Artificial Sequence
  derived and/or modified sequence opt4 from neuraminidase__InfluenzaA__AJK00167
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacgccaacuuccugaccgagaacgccguggccagcgugacccuggccggcaacagcagccugugccccgugagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccgagaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178508 - RNA, 1350 nt, Artificial Sequence
  derived and/or modified sequence opt4 from neuraminidase__InfluenzaA__AJK00178
augaaccccaaccagaagaucaucaccaucggcagcaucugcauggugaucggcaucgugagccugaugcugcagaucggcaacaugaucagcaucugggccagccacagcaucagaaccggcaaccagaaccagguggagcccaucaucaacaccaacuuccccaccgagaaggccgccgccagcaucacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagaccuggagaaacaacauccugagaacccaggagagcgagugcgccugcgugaacggcagcugcuucaccgugaugaccgacggccccagcgacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaccgacggcaccggcagcugcggccccgugagccacaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugagcuggagcuggcccgacggcgccgagcugcccuucaccaucgacaaguga

SEQ ID NO: 178509 - RNA, 1350 nt, Artificial Sequence
  derived and/or modified sequence opt4 from neuraminidase__InfluenzaA__AJK00199
augaaccccaaccagaagaucaucaccaucggcagcaucugcauggugaucggcaucgugagccugaugcugcagaucggcaacaugaucagcaucugggugagccacagcauccagaccggcaaccagaaccagguggagcccaucaucaacaccaacuuccugaccgagaaggccguggugagcaucacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccgccgccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcagccccgugagccacaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugagcuggagcuggcccgacggcgccgagcugcccuucaccaucgacaaguga

SEQ ID NO: 178510 - RNA, 1350 nt, Artificial Sequence
  derived and/or modified sequence opt4 from neuraminidase__InfluenzaA__AJK00208
augaaccccaaccagaagaucaucaccaucggcagcaucugcauggugaccggcaucgugagccugaugcugcagaucggcaacaucaucagcaugugggugagccacagcauccagaccagaaaccagcaccagaccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggagaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178511 - RNA, 1350 nt, Artificial Sequence
  derived and/or modified sequence opt4 from neuraminidase__InfluenzaA__AJK00219
augaaccccaaccagaagaucaucaccaucggcagcaucugcauggugaccggcaucgugagccugaugcugcagaucggcaacaucaucagcaugugggugagccacagcauccagaccagaaaccagcaccaggccgagcccaucagaaacaccaacuuccugaccgagaacgccguggccagcgugacccuggccggcaaccugagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggagaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178512 - RNA, 1350 nt, Artificial Sequence
  derived and/or modified sequence opt4 from neuraminidase__InfluenzaA__AJK00230
augaaccccaaccagaagaucaucaccaucggcagcaucugcauggugaccggcaucgugagccugaugcugcagaucggcaacaucaucagcaugugggugagccacagcauccagaccagaaaccagcaccagaccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugaucaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcgacuucagcgugaagcaggacaucguggagaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178513 - RNA, 1380 nt, Artificial Sequence
  derived and/or modified sequence opt4 from neuraminidase__InfluenzaA__AJS18470
augaaccccaaccagaagaucaccugcaucagcgccaccggcgugacccugagcguggugagccugcugaucggcaucgccaaccugggccugaacaucggccugcacuacaagguggacgacagcaccaccaucaacauccccaacaugaacgagaccaaccccaccaucaccaacaucaccaacaucaucgugaacaagaacgaggagagaaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggugggcaacauccugagaacccaggagagcgagugcgugugccacaagggcaucugccccguggugaugaccgacggccccgccaacaacaaggccgccaccaagaucaucuacuucaaggagggcaagauccagaagaucgaggagcugcagggcaacgcccagcacguggaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgcccccaucaucggcggcagccccgaccccggcgugaagggcuucgccuaccuggacggcgagaacagcuggcugggcagaaccaucagcaaggacagcagaagcggcuacgagaugcugaaggugcccaacgccgagaccgacacccagagcggccccaccagcuaccagcugaucgugaacaaccagaacuggagcggcuacagcggcgccuucaucgacuacugggccaacaagggcugcuucaaccccugcuucuacguggagcugaucagaggcagacccaaggagaucgacgugcuguggaccagcaacagcaugguggcccugugcggcagcagagagagacugggcagcuggagcuggcacgacggcgccgagaucaucuacuucaaguga

SEQ ID NO: 178514 - RNA, 1380 nt, Artificial Sequence
  derived and/or modified sequence opt4 from neuraminidase__InfluenzaA__AJS18481
augaaccccaaccagaagaucaccugcaucagcgccaccggcgugacccugagcguggugagccugcugaucggcaucgccaaccugggccugaacaucggccugcacuacaaggugagcgacagcaccaccaucaacagccccaacaugaacgagaccaaccccaccaccaccaacaucaccaacaucaucgugaacaagaacgaggagagaaccuuccugaaccugaccaagccccugugcgaggugaacagcuggcacauccugagcaaggacaacgccaucagaaucggcgaggaggcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggccggcaacauccugagaacccaggagagcgagugcgugugccacaagggcaucugccccguggugaugaccgacggccccgccaacaacaaggccgccaccaagaucaucuacuucagagagggcaagauccagaagaucgaggagcugcagggcaacgcccagcacaucgaggagugcagcugcuacggcgccgccggcaugaucaagugcgccugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgcccccgugaccggcggcagccccgaccccggcaucaagggcuucgccuuccuggacggcgagaacagcuggcugggcagaaccaucagcaagaacagcagaagcggcuacgagaugcugaaggugcccaacgccgagaccgacacccagagcggccccaccagcuaccagcugaucgugaacaaccagaacuggagcggcuacagcggcgccuucaucgacuacugggccaacaaggagugcuucaaccccugcuucuacguggagcugaucagaggcagacccaaggagagcgacgugcuguggaccagcaacagcaugguggcccugugcggcagcagagagagacugggcagcuggagcuggcacgacggcgccgagaucaucuacuucaaguga

SEQ ID NO: 178515 - RNA, 1410 nt, Artificial Sequence
  derived and/or modified sequence opt4 from neuraminidase__InfluenzaA__AKA59350
augaaccccaaccagaagaucaucaccaucggcagcgugugcaugaccaucggcguggccaaccugauccugcagaucggcaacaucaucagcaucuggaucagccacagcauccagcugggcaaccagaaccagaucgagaccugcaaccagagcgugaucaccuacgagaacaacaccugggugaaccagaccgacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 178516 - RNA, 1410 nt, Artificial Sequence
  derived and/or modified sequence opt4 from neuraminidase__InfluenzaA__AKA59352
augaaccccaaccagaagaucaucaccaucggcagcgugugcaugaccaucggcauggccaaccugaugcugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaaccuggccgugggccagagcguggugagcaccaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178517 - RNA, 1410 nt, Artificial Sequence
  derived and/or modified sequence opt4 from neuraminidase__InfluenzaA__AKA59354
augaaccccaaccagaagaucaucaccaucggcagcgugugcaugaccaucggcguggccaaccugauccugcagaucggcaacaucaucagcaucuggaucagccacagcauccagcugggcaaccagaaccagaucgagaccugcaaccagagcgugaucaccuacgagaacaacaccugggccaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgugugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccgagaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccguguggaccagcggcagcagcaucagcuucugcggcgugaacagcgacaccgugggcuggagcuggcccgacggcgccgagcugcccuucaccaucgacaaguga

SEQ ID NO: 178518 - RNA, 1380 nt, Artificial Sequence
  derived and/or modified sequence opt4 from neuraminidase__InfluenzaA__AKS48026
augaaccccaaccagaagaucaccugcaucagcgccaccggcgugacccugagcguggugagccugcugaucggcaucgccaaccugggccugaacaucggccugcacuacaaggugagcgacagcaccaccaucaacauccccaacaugaacgagaccaaccccaccaccaccaacaucaccaacaucaucgugaacaagaacgaggagagaaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacaagagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggugggcaacauccugagaacccaggagagcgagugcgugugccacaagggcaucugccccguggugaugaccgacggccccgccaacaacaaggccgccaccaagaucaucuacuucaaggagggcaagauccagaagaucgaggagcugcagggcaacgcccagcacaucgaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgagcccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagcuaccagcugaucgugaacaaccagaacuggagcggcuacagcggcgccuucaucgacuacugggccaacaaggagugcuucaaccccugcuucuacguggagcugaucagaggcagacccaaggagaucgacgugcugugggccagcaacagcaugguggcccugugcggcagcagagagagacugggcagcuggagcuggcacgacggcgccgagaucaucuacuucaaguga

SEQ ID NO: 178519 - RNA, 1380 nt, Artificial Sequence
  derived and/or modified sequence opt4 from neuraminidase__InfluenzaA__AKS48040
augaaccccaaccagaagaucaccugcaucagcgccaccggcaugacccugagcguggugagccugcugaucggcaucgccaaccugggccugaacaucggccugcacuacaaggugagcgacagcaccaccaucaacauccccaacaugaacgagaccaaccccaccaccaccaacaucaccaacaucaucgugaacaagaacgaggagagaaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggugggcaacauccugagaacccaggagagcgagugcgugugccacaagggcaucugccccguggugaugaccgacggccccgccaacaacaaggccgccaccaagaucaucuacuucaaggagggcaagauccagaagaucgaggagcugcagggcaacgcccagcacaucgaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagcuaccagcugaucgugaacaaccagaacuggagcggcuacagcggcgccuucaucgacuacugggccaacaaggagugcuucaaccccugcuucuacguggagcugaucagaggcagacccaaggagaucgacgugcugugggccagcaacagcaugguggcccugugcggcagcagagagagacugggcagcuggagcuggcacgacggcgccgagaucaucuacuucaaguga

SEQ ID NO: 178520 - RNA, 1380 nt, Artificial Sequence
  derived and/or modified sequence opt4 from neuraminidase__InfluenzaA__ALO75898
augaaccccaaccagaagaucaccugcaucagcgccaccggcgugacccugagcguggugagccugcugaucggcaucgccaaccugggccugaacaucggccugcacuacaaggugagcgacagcaccaccaucaacauccccaacaugaacgagaccaaccccaccaccaccaacaucaccaacaucaucgugaacaagaacgaggagagaaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggugggcaacauccugagaacccaggagagcgagugcgugugccacaagggcaucugccccguggugaugaccgacggccccgccaacaacaaggccgccaccaagaucaucuacuucaaggagggcaagauccagaagaucgaggagcugcagggcaacgcccagcacaucgaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagcuaccagcugaucgugaacaaccagaacuggagcggcuacagcggcgccuucaucgacuacugggccaacaaggagugcuucaaccccugcuucuacguggagcugaucagaggcagacccaaggagaucgacgugcugugggccagcaacagcaugguggcccugugcggcagcagagagagacugggcagcuggagcuggcacgacggcgccgagaucaucuacuucaaguga

SEQ ID NO: 178521 - RNA, 1380 nt, Artificial Sequence; identical to SEQ ID NO: 178520
  derived and/or modified sequence opt4 from neuraminidase__InfluenzaA__ALO75910

SEQ ID NO: 178522 - RNA, 1380 nt, Artificial Sequence
  derived and/or modified sequence opt4 from neuraminidase__InfluenzaA__ALO75922
augaaccccaaccagaagaucaccugcaucagcgccaccggcgugacccugagcguggugagccugcugaucggcaucgccaaccugggccugaacaucggccugcacuacaaggugagcgacagcaccaccaucaacauccccaacaugaacgagaccaaccccaccaccaccaacaucaccaacaucaucgugaacaagaacgaggagagaaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggugggcaacauccugagaacccaggagagcgagugcgugugccacaagggcaucugccccguggugaugaccgacggccccgccaacaacaaggccgccaccaagaucaucuacuucaaggagggcaagauccagaagaucgaggagcugcagggcaacgcccagcacaucgaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgagcccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagcuaccagcugaucgugaacaaccagaacuggagcggcuacagcggcgccuucaucgacuacugggccaacaaggagugcuucaaccccugcuucuacguggagcugaucagaggcagacccaaggagaucgacgugcugugggccagcaacagcaugguggcccugugcggcagcagagagagacugggcagcuggagcuggcacgacggcgccgagaucaucuacuucaaguga

SEQ ID NO: 178523 - RNA, 1401 nt, Artificial Sequence
  derived and/or modified sequence opt4 from neuraminidase__InfluenzaA__ALT20083
augaaccccaaccagagaaucaccgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccagcggcgacaucugggugaccagagagcccuacgugagcugcagccugaacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacgugugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcaacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 178524 - RNA, 1410 nt, Artificial Sequence
  derived and/or modified sequence opt4 from neuraminidase__InfluenzaA__AMA65392
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcagaggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178525 - RNA, 1410 nt, Artificial Sequence
  derived and/or modified sequence opt4 from neuraminidase__InfluenzaA__AMA65394
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178526 - RNA, 1410 nt, Artificial Sequence
  derived and/or modified sequence opt4 from neuraminidase__InfluenzaA__BAA00618
augaaccccaaccagaagaucaucaccaugggcagcgugagcaucaucaucgccaucgugugccugcugaugcagaucgccauccuggugaccaccgugacccugcacuucagacagcacgagagcgacagcccccccagcaaccaggugauccccugcgagcccaucaucaucgagagaaacaucaccgagaucguguaccugaacaacaccaccaucgagaaggagaccugccccaagagcguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacaacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagccccgugguggacaucaacaugaaggacuacagcaucgacagcagcuacgugugcagcggccuggugggcgacacccccagaaacgacgacagaagcagcaagagcaacugcagaaaccccaacaacgagagaggcaaccacggcgugaagggcugggccuucgacaacggcgacgacguguggaugggcagaaccaucagcaaggaccugagaagcggcuacgagaccuucaaggugaucggcggcuggagcacccccaacagcaagagccagaccaacagacaggugaucguggacagcaacaacuggagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucgacuucaugcccaucuga

SEQ ID NO: 178527 - RNA, 1410 nt, Artificial Sequence
  derived and/or modified sequence opt4 from neuraminidase__InfluenzaA__BAA00619
augaaccccaaccagaagaucaucaccaucggcagcgugagccugaccuucgccgccaucugcuuccugaugcagaucgccauccuggugaccaccgugacccugaacuucaagcaguacgagugcgacccccccgccaccaaccaggugaugcccugcgagcccaucaucaucgagagaaacaucaccgagaucguguaccugaccaacaccaccaucgagagagagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcagaugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcaucaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccagaauccuguucaucgaggagggcagaaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucaacagcagcuacgugugcagcggccuggugggcgacacccccagaaacaacgacagaagcagcaacagcuacugccagaaccccaacaacgagaagggcaaccacggcgugaagggcugggccuucgacgacggcaacgacguguggaugggcagaaccaucagcgaggacagcagaagcggcuaccagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagaagacaggagaccagagugugguggaccagcaacagcaucgugguguucugcggcaccagcggcaccuacggcaccggcagcuggcccgacggcgccgacaucaaccugaugcccaucuga

SEQ ID NO: 178528 - RNA, 1410 nt, Artificial Sequence
  derived and/or modified sequence opt4 from neuraminidase__InfluenzaA__BAA00620
augaaccccaaccagaagaucaugaccaucggcagcgugagccugaucaucgccgccgugugcuuccugaugcagaucgccauccuggugaccaccgugacccugcacuucaagcagugcgagugcgacagccccagcaacaaccaggugaagcccugcgagcccaucaucaucgagagaaacaucaccgagaucguguaccugaacaacaccaccaucgagaaggagaccugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccaacgugagaugcaucugcagagacaacuggaagggcagcaacagacccaucguggacaucaacaugaaggacuacagcaucgacagcagcuacgugugcagcggccuggugggcgacacccccagaaacgacgacagaagcagcaagagcaacugcagaaaccccaacaacgagaagggcaaccacggcgugaagggcugggccuucgacaacggcgacgacguguggaugggcagaaccaucagcaaggaccugagaagcggcuacgagaccuucaaggugaucggcggcugguucacccccaacagcaagagccaggugaacagacaggugaucguggacagcgacaacagaagcggcuacagcggcaucuucagcguggagggcaagagcugcaucaacagaugcuucuacguggagcugaucagaggcagaggccaggagaccagagugugguggaccagcaacagcaucgugguguucugcggcaccagcggcaccuacggcaagggcagcuggcccgacggcgccaacaucaacuucaugcccaucuga

SEQ ID NO: 178529 - RNA, 1410 nt, Artificial Sequence
  derived and/or modified sequence opt4 from neuraminidase__InfluenzaA__BAA00621
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaccagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaagaacgacagaagcagcagcagcuacugcagaaaccccaacaacgagaagggcacccacggcgugaagggcugggccuucgacgacggcaacgacguguggaugggcagaaccaucagcgaggacagcagaagcggcuacgagaccuucaaggugaucggcggcuggagcacccccaacagcaagcugcagaucaacagacaggugaucguggacagcaacgacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 178530 - RNA, 1413 nt, Artificial Sequence
  derived and/or modified sequence opt4 from neuraminidase__InfluenzaA__BAA06714
augaaccccaaccagaagaucaucaccaucggcagcaucagcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaagacugaugagcugcccccugggcgaggcccccagccccuacaacagcagauucgagagcaucgccuggagcgccagcgccugccacgacggcaugggcuggcugaccaucggcaucagcggccccgacgacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggccaggccagcuacagaaucuucaagaucgagaagggcaaggugaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccccccccaaggacggcaagggcagcugcgaccccgugaccguggacggcgccgacggcgugaagggcuucagcuacagauacggcaacggcguguggaucggcagaaccaagagcaacagauucagaaagggcuucgagaugaucugggaccccaacggcuggaccgacaccgacagcgacuuccuggugaagcaggacgugguggccaugaccgacuggagcggcuacagcggcagcuucgugcagcaccccgagcugaccggccuggacugcaugagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178531 - RNA, 1413 nt, Artificial Sequence
  derived and/or modified sequence opt4 from neuraminidase__InfluenzaA__BAA06715
augaaccccaaccagaagaucaucaccaucggcagcaucagcauggccaucggcaucaucagccugauccugcagaucggcaacaucaucagcaucugggccagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcaaggugaccaagagcaucgagcuggacgcccccaacuaccacuacgaggagugcagcugcuaccccgacaccggcaccgugaugugcgugugcagagacaacuggcacggcagcaacagacccagcgugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcgugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 178532 - RNA, 1410 nt, Artificial Sequence
  derived and/or modified sequence opt4 from neuraminidase__InfluenzaA__BAA06716
augaacaccaaccagagaaucaucaccaucggcaccaucugccugaucgugggcaucaucagccugcugcugcagaucggcaacaucauccugcuguggaugagccacagcauccagaccggcgagaagagccaccccaaggugugcaaccagagcgugaucaccuacgagaacaacaccugggugaaccagaccuacgugaacaucagcaacaccaacaucgccgccggccagggcgugacccccaucauccuggccggcaacagcagccugugccccaucagcggcugggccaucuacagcaaggacaacagcaucagaaucggcagcaagggcgacaucuucgugaugagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagcuguucaagauggagaagggcaagaucaucaagagcaucgagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagaggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcgugaacagcggcaccgccagcuggagcuggcccgacggcgccgaccugcccuucaccaucgacaaguga

SEQ ID NO: 178533 - RNA, 1413 nt, Artificial Sequence
  derived and/or modified sequence opt4 from neuraminidase__InfluenzaA__BAA06717
augaaccccaaccagaagaucaucaccaucggcagcaucagcauggccaucggcaucaucagccugauccugcagaucggcaacaucaucagcaucugggccagccacagcauccagaccggcagccagaaccacaccggcaucugcaaccagagaaugaucaccuacgagaacagcaccugggugaaccagaccuacgugaacaucagcaacaccaacgugguggccggcaaggacaagaccagcgugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagcagauccugagaacccaggagagcgagugcgugugcgugaacggcagcugcuucaccaucaugaccgacggccccagcgacggccccgccagcuacagaaucuucaagaucgagaagggcaaggugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcgugaagcaggacgugguggccaugaccgacuggagcggcuacagcggcagcuucgugcagcaccccgagcugaccggccuggacugcaugagacccugcuucuggguggagcugaucagaggcagacccagagagaagaccaccaucuggaccagcggcagcagcaucagcuucugcggcgugaacagcgacaccgccaacuggagcuggcccgacggcgccgagcugcccuucaccaucgacaaguga

SEQ ID NO: 178534 - RNA, 1413 nt, Artificial Sequence
  derived and/or modified sequence opt4 from neuraminidase__InfluenzaA__BAA06718
augaaccccaaccagaagaucaucaccaucggcagcaucugcauggccaucggcaucaucagccugauccugcagaucggcaacaucgugagcaucuggaucagccacagcauccagaccggcagccagaacuacaccggcaucugcaaccagagaaucaucaccuacgagaacagcaccugggugaaccagaccuacgugaacaucaacaacaccaacgugguggccggccaggacaccaccagcguggcccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaagacugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggagaaagagaauccugagaacccaggagagcgagugcgugugcgugaacggcagcugcuucaccaucaugaccgacggccccaacaacggccccgccagcuacagaaucuucaagaucgagaagggcaagaucaccaagagcaucgagcuggacgcccccaacagccacuacgaggagugcagcugcuaccccgacgccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaccguggacggcgccgacggcgugaagggcuucagcuacagauacggcaacggcguguggaucggcagaaccaagagcaacagcagcagaagaggcuucgagaugaucugggaccccaacggcuggaccgacaccgacagcaaguuccuggugaagcaggacgugguggccaugaccgacuggagcggcuacagcggcagcuucgugcagcaccccgagcugaccggccuggacugcaugagacccugcuucuggguggagcuggugagaggcagacccagagagaacaccaccaucuggaccagcggcagcagcaucagcuucugcggcgugaacggcgacaccgccaacuggagcuggcccgacggcgccgagcugcccuucaccaucgacaaguga

SEQ ID NO: 178535 - RNA, 1413 nt, Artificial Sequence
  derived and/or modified sequence opt4 from neuraminidase__InfluenzaA__BAA06720
augaaccccaaccagaagaucaucaccaucggcagcaucagcauggccaucggcaucaucagccugauccugcagaucggcaacaucaucagcaucugggugagccacagcauccagaccggcagccagaaccacaccggcaucugcaaccagagaaucaucaccuacgagaacagcaccugggugaaccagaccuacgugaacaucaacaacaccaacgugguggccggcaaggacaagaccagcgugacccuggccggcaacagcagccugugccccauccugggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaagacugaugagcugcccccugggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcaaggugaccaagagcaucgagcuggacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccccccccaaggacggcaagggcagcugcaaccccgugaccguggacggcgccgacggcgugaagggcuucagcuacagauacggcaacggcguguggaucggcagaaccaagagcaacagauucagaaagggcuucgagaugaucugggaccccaacggcuggaccgacaccgacagcgacuucagcgugaagcaggacgugguggccaugaccgacuggagcggcuacagcggcagcuucgugcagcaccccgagcugaccggccuggacugcaugagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178536 - RNA, 1410 nt, Artificial Sequence
  derived and/or modified sequence opt4 from neuraminidase__InfluenzaA__BAD16637
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucagcaaggacagcagaagcggcuacgagaccuucaaggugaucggcggcuggagcacccccaacagcaagagccaggugaacagacaggugaucgugggcaacaacaacuggagcggcuacagcggcaucuucagcguggagggcaagagcugcaucaacagaugcuucuacguggagcugaucagaggcaugccccaggagaccagagugugguggaccagcaacagcaucgugguguucugcggcaccagcggcaccuacggcaccggcagcuggcccgacggcgccaacaucaacuucaugcccaucuga

SEQ ID NO: 178537 - RNA, 1410 nt, Artificial Sequence
  derived and/or modified sequence opt4 from neuraminidase__InfluenzaA__BAD16638
augaaccccaaccagaagaucaucaccaucggcagcgugagccugaccaucgccaccgugugcuuccugaugcagaucgccauccuggccaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcguggccuggagcagcagcagcugccacgacggcaaggccuggcugcacgugugcgugaccggcgacgacagaaacgccaccgccagcuucaucuacgacggcagacugguggacagcaucggcagcuggagccagaacauccugagaacccacgagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagcagcagcaacagcaacugcagagaccccaacaacgagagaggcaaccccggcgugaagggcugggccuucgacaacggcgacgacguguggaugggcagaaccaucaacaaggacagcagaagcggcuacgagaccuucaaggugaucggcggcuggagcacccccaacagcaagagccaggugaacagacaggugaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 178538 - RNA, 1410 nt, Artificial Sequence; identical to SEQ ID NO: 175717
  derived and/or modified sequence opt4 from neuraminidase__InfluenzaA__BAD16639

SEQ ID NO: 178539 - RNA, 1410 nt, Artificial Sequence
  derived and/or modified sequence opt4 from neuraminidase__InfluenzaA__BAD16640
augaaccccaaccagaagaucaucaccaucggcagcgugagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaucaccgagaucguguaccugaacaacaccaccaucgagaaggagaucugccccgaggugguggaguacagaaacuggagcaagccccagugccagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcguggccuggagcagcagcagcugccacgacggcaaggccuggcugcacgugugcgugaccggcgacgacaagaacgccaccgccagcuucaucuacgacggcagacugauggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugaucgacaucaacauggaggacuacagcaucgacagcagcuacgugugcagcggccuggugggcgacacccccagaaacgacgacagaagcagcaacagcaacugcagaaaccccaacaacgagagaggcaaccccggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcaacaacuggagcggcuacagcggcaucuucagcguggagggcaagagcugcaucaacagaugcuucuacguggagcugaucagaggcagacagcaggagaccagagugugguggaccagcaacagcaucgugguguucugcggcaccagcggcaccuacggcaccggcagcuggcccgacggcgccaacaucaacuucaugcccaucuga

SEQ ID NO: 178540 - RNA, 1410 nt, Artificial Sequence
  derived and/or modified sequence opt4 from neuraminidase__InfluenzaA__BAD16641
augaaccccaaccagaagaucaucaccaucggcagcgccagccugaccaucgccaccgugugcuuccugaugcagaucgccauccuggugaccaccgugacccugcacuucaagcagcacgagugcgacagccccgccagcaaccaggugaugcccugcgagcccaucaucaucgagagaaacaccaccgagaucguguaccugaacaacaccaccaucgagaaggagaucugccccaaggugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcgugaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccgacgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagaagggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaaccugaugcccaucuga

SEQ ID NO: 178541 - RNA, 1410 nt, Artificial Sequence
  derived and/or modified sequence opt4 from neuraminidase__InfluenzaA__BAD16642
augaaccccaaccagaagaucaucaccaucggcagcgugagccugaccaucgccaccgugugcuuccugaugcagaucgccauccuggugaccaccgugacccugcacuucaagcaguacgagugcgacagccccgccagcaaccaggugaugcccugcgagcccaucaucaucgagagaaacaucaccgagaucguguaccugaacaacaccaccaucgacaaggagaagugccccaaggugguggaguacagaaacuggagcaagccccagugccagaucaccggcuucgcccccuucagcaaggacaacagcaucagacugagcgccggcggcgacaucugggugaccagagagcccuacgugagcugcgaccacggcaagugcuaccaguucgcccugggccagggcaccacccuggacaacaagcacagcaacgacaccauccacgacagaaucccccacagaacccugcugaugaacgagcugggcgugcccuuccaccugggcaccagacaggugugcaucgccuggagcagcagcagcugccacgacggcaaggccuggcugcacgugugcaucaccggcgacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccagaauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacauggaggacuacagcaucgacagcagcuacgugugcagcggccuggugggcgacacccccagaaacgacgacagaagcagcaacagcaacugcagaaaccccaacaacgagagaggcaaccagggcgugaagggcugggccuucgacaacggcgacgacguguggaugggcagaaccaucagcaaggaccugagaagcggcuacgagaccuucaaggugaucggcggcuggagcacccccaacagcaagagccagaucaacagacaggugaucguggacagcgacaacagaagcggcuacagcggcaucuucagcguggagggcaagagcugcaucaacagaugcuucuacguggagcugaucagaggcagaaagcaggagaccagagugugguggaccagcaacagcaucgugguguucugcggcaccagcggcaccuacggcaccggcagcuggcccgacggcgccaacaucaacuucaugcccaucuga

SEQ ID NO: 178542 - RNA, 1410 nt, Artificial Sequence
  derived and/or modified sequence opt4 from neuraminidase__InfluenzaA__BAD16643
augaaccccaaccagaagaucaucaccaucggcagcgugagccugaccaucgccaccaucugcuuccugaugcagaucgccauccuggugaccaccgugacccugcacuucaagcaguacgagugcgacagccccgccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagccagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcuacgagaccuucaaggugaucggcggccuguucacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 178543 - RNA, 1410 nt, Artificial Sequence
  derived and/or modified sequence opt4 from neuraminidase__InfluenzaA__BAD16644
augaaccccaaccagaagaucaucaccaucggcagcgugagccugaccaucgccaccaucugcuuccugaugcagaucgccauccuggugaccaccgugacccugcacuucaagcaguacgagugcgacagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaaccccccacagaacccugcugaugaacgagcugggcgugcccuuccaccugggcaccagacaggugugcaucgccuggagcagaagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcgugagaugcaucugcagagacaacuggaagggcagcaacagacccgugguggacaucaacgugaaggacuacagcaucgacagcagcuacgugugcagcggccuggugggcgacacccccagaaacaacgacagaagcagcaacagcuacugcagaaaccccaacaacgagaagggcaaccacggcgugaagggcugggccuucgacgacggcaacgacguguggaugggcagaaccaucagcgaggacagcagaagcggcugcgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 178544 - RNA, 1410 nt, Artificial Sequence; identical to SEQ ID NO: 167096
  derived and/or modified sequence opt4 from neuraminidase__InfluenzaA__BAD16645

SEQ ID NO: 178545 - RNA, 1410 nt, Artificial Sequence; identical to SEQ ID NO: 175064
  derived and/or modified sequence opt4 from neuraminidase__InfluenzaA__BAD16646

SEQ ID NO: 178546 - RNA, 1410 nt, Artificial Sequence; identical to SEQ ID NO: 167096
  derived and/or modified sequence opt4 from neuraminidase__InfluenzaA__BAD16647

SEQ ID NO: 178547 - RNA, 1410 nt, Artificial Sequence
  derived and/or modified sequence opt4 from neuraminidase__InfluenzaA__BAD16648
augaaccccaaccagaagaucaucaccaucggcagcgugagccugaccaucgccaccaucugcuuccugaugcagaucgccauccuggugaccaccgugacccugcacuucaagcaguacgagugcagcagcccccccaacaaccaggugaugcccugcgagcccaucaucaucgagagaaacaucaccgagaucguguaccugaccaacaccaccaucgagaaggagaucugccccaagcugguggaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccuggacaacaagcacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggcuacgacaagaacgccaccgccagcuucaucuacgacggcagacugguggacagcaucggcagcuggagcaagaacauccugagaacccaggagagcgagugcgugugcaucuacggcaccugcaccguggugaugaccgacggcagcgccagcgagagagccgagaccaagauccuguucaucgaggagggcaagaucgugcacaucagcccccugagcggcagcgcccagcacguggaggagugcagcugcuaccccagauaccccggcgugagaugcgugugcagagacaacuggaagggcagcaacagacccgugguggacaucaacgugaaggacuacagcaucgugagcagcuacgugugcagcggccuggugggcgacacccccagaaagaacgacagaagcagcagcagcuacugcagaaaccccaacaacgagaagggcaaccacggcgugaagggcugggccuucgacgacggcaacgacguguggaugggcagaaccaucagcgaggagagcagaagcggcuacgagaccuucaaggugaucggcggcuggagcacccccaacagcaagcugcagaucaacagacaggugaucguggacagcgacaacagaagcggcuacagcggcaucuucagcguggagggcaagagcugcaucaacagaugcuucuacguggagcugaucagaggcagagagcaggagaccagagugugguggaccagcaacagcaucgugguguucugcggcaccagcggcaccuacggcaccggcagcuggcccgacggcgccgacaucaaccugaugcccaucuga

SEQ ID NO: 178548 - RNA, 1410 nt, Artificial Sequence
  derived and/or modified sequence opt4 from neuraminidase__InfluenzaA__BAE07203
augaaccccaaccagaagaucaccaccaucggcagcaucugcauggugaucggcaucgugagccugaugcugcagaucggcaacaucaucagcaucugggugagccacagcauccagaccggcaaccagcaccaggccgagcccugcaaccagagcaucaucaccuacgagaacaacaccugggugaaccagaccuacgugaacaucagcaacaccaacuuccugaccgagaaggccguggccagcgugacccuggccggcaacagcagccugugccccaucagcggcugggccguguacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcaacggccaggccagcuacaagaucuucagaaucgagaagggcaagguggugaagagcgccgagcugaacgcccccaacuaccacuacgaggagugcagcugcuaccccgacgccggcgagaucaccugcgugugcagagacaacuggcacggcagcaacagacccugggugagcuucaaccagaaccuggaguacagaaucggcuacaucugcagcggcguguucggcgacaaccccagacccaacgacggcaccggcagcugcggccccgugagccccaagggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 178549 - RNA, 1410 nt, Artificial Sequence
  derived and/or modified sequence opt4 from neuraminidase__InfluenzaA__BAF46322
augaaccccaaccccaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178550 - RNA, 1410 nt, Artificial Sequence; identical to SEQ ID NO: 167234
  derived and/or modified sequence opt4 from neuraminidase__InfluenzaA__BAF46323

SEQ ID NO: 178551 - RNA, 1410 nt, Artificial Sequence
  derived and/or modified sequence opt4 from neuraminidase__InfluenzaA__BAF46324
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaucgugcacgacagaacccccuacagaacccugcugaugaacgagcugggcgugcccuuccaccugggcaccaagcaggugugcaucgccuggagcagcagcagcugccacgacggcaaggccuggcugcacgugugggugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178552 - RNA, 1410 nt, Artificial Sequence
  derived and/or modified sequence opt4 from neuraminidase__InfluenzaA__BAF46332
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccaccacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178553 - RNA, 1410 nt, Artificial Sequence
  derived and/or modified sequence opt4 from neuraminidase__InfluenzaA__BAF46334
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178554 - RNA, 1410 nt, Artificial Sequence; identical to SEQ ID NO: 178553
  derived and/or modified sequence opt4 from neuraminidase__InfluenzaA__BAF46335

SEQ ID NO: 178555 - RNA, 1410 nt, Artificial Sequence
  derived and/or modified sequence opt4 from neuraminidase__InfluenzaA__BAF46337
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagugagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggauggccagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178556 - RNA, 1410 nt, Artificial Sequence; identical to SEQ ID NO: 178553
  derived and/or modified sequence opt4 from neuraminidase__InfluenzaA__BAF46345

SEQ ID NO: 178557 - RNA, 1410 nt, Artificial Sequence
  derived and/or modified sequence opt4 from neuraminidase__InfluenzaA__BAF46346
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucgccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugaucugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178558 - RNA, 1410 nt, Artificial Sequence
  derived and/or modified sequence opt4 from neuraminidase__InfluenzaA__BAF46347
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccaccuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178559 - RNA, 1410 nt, Artificial Sequence
  derived and/or modified sequence opt4 from neuraminidase__InfluenzaA__BAF46349
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagccagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaagguguucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178560 - RNA, 1410 nt, Artificial Sequence; identical to SEQ ID NO: 178553
  derived and/or modified sequence opt4 from neuraminidase__InfluenzaA__BAF46350

SEQ ID NO: 178561 - RNA, 1410 nt, Artificial Sequence
  derived and/or modified sequence opt4 from neuraminidase__InfluenzaA__BAF46351
augaaccccauccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaugguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178562 - RNA, 1410 nt, Artificial Sequence
  derived and/or modified sequence opt4 from neuraminidase__InfluenzaA__BAF46368
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178563 - RNA, 1410 nt, Artificial Sequence
  derived and/or modified sequence opt4 from neuraminidase__InfluenzaA__BAF46369
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcaagcugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagagcagaagcggcuacgagaccuuccaggugaucgagggcuggagcaacagcaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178564 - RNA, 1410 nt, Artificial Sequence
  derived and/or modified sequence opt4 from neuraminidase__InfluenzaA__BAF46370
augaaccccaaccagaagaucaucaccaucggcagcgugagccugaccaucagcaccaucugcuucuucaugcagaucgccauccugaucaccaccgugacccugcacuucaagcaguacgaguucaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaccagcaucgugguguucugcggcagcagcggcaccuacggcaccggcagcuggcccgacggcgccgacaucaaccugaugcccaucuga

SEQ ID NO: 178565 - RNA, 1410 nt, Artificial Sequence
  derived and/or modified sequence opt4 from neuraminidase__InfluenzaA__BAF46371
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucgugcaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaagcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178566 - RNA, 1410 nt, Artificial Sequence
  derived and/or modified sequence opt4 from neuraminidase__InfluenzaA__BAF46372
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucgccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178567 - RNA, 1410 nt, Artificial Sequence
  derived and/or modified sequence opt4 from neuraminidase__InfluenzaA__BAF46385
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccccgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgccagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcagcaccuacggcaccggcagcuggcccgacggcgccgacaucaaccugaugcccaucuga

SEQ ID NO: 178568 - RNA, 1410 nt, Artificial Sequence
  derived and/or modified sequence opt4 from neuraminidase__InfluenzaA__BAF46386
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcagcaccuacggcaccggcagcuggcccgacggcgccgacaucaaccugaugcccaucuga

SEQ ID NO: 178569 - RNA, 1410 nt, Artificial Sequence; identical to SEQ ID NO: 169084
  derived and/or modified sequence opt4 from neuraminidase__InfluenzaA__BAF46387

SEQ ID NO: 178570 - RNA, 1410 nt, Artificial Sequence
  derived and/or modified sequence opt4 from neuraminidase__InfluenzaA__BAF46388
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggacaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 178571 - RNA, 1410 nt, Artificial Sequence
  derived and/or modified sequence opt4 from neuraminidase__InfluenzaA__BAF47922
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacauccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgccagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178572 - RNA, 1410 nt, Artificial Sequence; identical to SEQ ID NO: 167214
  derived and/or modified sequence opt4 from neuraminidase__InfluenzaA__BAF47923

SEQ ID NO: 178573 - RNA, 1410 nt, Artificial Sequence
  derived and/or modified sequence opt4 from neuraminidase__InfluenzaA__BAF47924
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacagcgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178574 - RNA, 1410 nt, Artificial Sequence; identical to SEQ ID NO: 167232
  derived and/or modified sequence opt4 from neuraminidase__InfluenzaA__BAF47925

SEQ ID NO: 178575 - RNA, 1410 nt, Artificial Sequence; identical to SEQ ID NO: 167232
  derived and/or modified sequence opt4 from neuraminidase__InfluenzaA__BAF47926

SEQ ID NO: 178576 - RNA, 1410 nt, Artificial Sequence; identical to SEQ ID NO: 173219
  derived and/or modified sequence opt4 from neuraminidase__InfluenzaA__BAF47927

SEQ ID NO: 178577 - RNA, 1410 nt, Artificial Sequence; identical to SEQ ID NO: 169084
  derived and/or modified sequence opt4 from neuraminidase__InfluenzaA__BAF47928

SEQ ID NO: 178578 - RNA, 1410 nt, Artificial Sequence
  derived and/or modified sequence opt4 from neuraminidase__InfluenzaA__BAF47929
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaccgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcgacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgacaucaaccugaugcccaucuga

SEQ ID NO: 178579 - RNA, 1410 nt, Artificial Sequence
  derived and/or modified sequence opt4 from neuraminidase__InfluenzaA__BAF47930
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaccgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178580 - RNA, 1410 nt, Artificial Sequence; identical to SEQ ID NO: 173219
  derived and/or modified sequence opt4 from neuraminidase__InfluenzaA__BAF47931

SEQ ID NO: 178581 - RNA, 1410 nt, Artificial Sequence
  derived and/or modified sequence opt4 from neuraminidase__InfluenzaA__BAF47932
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178582 - RNA, 1410 nt, Artificial Sequence; identical to SEQ ID NO: 167232
  derived and/or modified sequence opt4 from neuraminidase__InfluenzaA__BAF47933

SEQ ID NO: 178583 - RNA, 1410 nt, Artificial Sequence; identical to SEQ ID NO: 167234
  derived and/or modified sequence opt4 from neuraminidase__InfluenzaA__BAF47934

SEQ ID NO: 178584 - RNA, 1410 nt, Artificial Sequence; identical to SEQ ID NO: 167234
  derived and/or modified sequence opt4 from neuraminidase__InfluenzaA__BAF47935

SEQ ID NO: 178585 - RNA, 1410 nt, Artificial Sequence
  derived and/or modified sequence opt4 from neuraminidase__InfluenzaA__BAF47936
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178586 - RNA, 1410 nt, Artificial Sequence
  derived and/or modified sequence opt4 from neuraminidase__InfluenzaA__BAF47937
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcggccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178587 - RNA, 1410 nt, Artificial Sequence
  derived and/or modified sequence opt4 from neuraminidase__InfluenzaA__BAF47938
augaaccccaaccagaagaucaucaccaucggcagcgugagccugaccaucagcaccaucugcuucuucaugcagaucgccauccugaucaccaccgugacccugcacuucaagcaguacgaguucaacagccugcccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178588 - RNA, 1410 nt, Artificial Sequence; identical to SEQ ID NO: 167234
  derived and/or modified sequence opt4 from neuraminidase__InfluenzaA__BAF47939

SEQ ID NO: 178589 - RNA, 1410 nt, Artificial Sequence
  derived and/or modified sequence opt4 from neuraminidase__InfluenzaA__BAF47940
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggagaagaccgaggugcuguggaccagcaacagcaucgugguguucugcggcaccagcggcaccuacggcaccggcagcuggcccgacggcgccgacaucaaccugaugcccaucuga

SEQ ID NO: 178590 - RNA, 1410 nt, Artificial Sequence; identical to SEQ ID NO: 167232
  derived and/or modified sequence opt4 from neuraminidase__InfluenzaA__BAF47941

SEQ ID NO: 178591 - RNA, 1410 nt, Artificial Sequence
  derived and/or modified sequence opt4 from neuraminidase__InfluenzaA__BAF47943
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaucgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178592 - RNA, 1410 nt, Artificial Sequence
  derived and/or modified sequence opt4 from neuraminidase__InfluenzaA__BAF47944
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcugaccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgaccccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178593 - RNA, 1410 nt, Artificial Sequence
  derived and/or modified sequence opt4 from neuraminidase__InfluenzaA__BAF47945
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaagcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178594 - RNA, 1410 nt, Artificial Sequence
  derived and/or modified sequence opt4 from neuraminidase__InfluenzaA__BAF47946
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugcuggagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178595 - RNA, 1410 nt, Artificial Sequence
  derived and/or modified sequence opt4 from neuraminidase__InfluenzaA__BAF47948
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaaggugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaacagcaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178596 - RNA, 1410 nt, Artificial Sequence
  derived and/or modified sequence opt4 from neuraminidase__InfluenzaA__BAF47949
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaaggugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178597 - RNA, 1410 nt, Artificial Sequence; identical to SEQ ID NO: 167234
  derived and/or modified sequence opt4 from neuraminidase__InfluenzaA__BAF47950

SEQ ID NO: 178598 - RNA, 1410 nt, Artificial Sequence
  derived and/or modified sequence opt4 from neuraminidase__InfluenzaA__BAF47951
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaacagcaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178599 - RNA, 1410 nt, Artificial Sequence
  derived and/or modified sequence opt4 from neuraminidase__InfluenzaA__BAF47952
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccaacaucaaccugaugcccaucuga

SEQ ID NO: 178600 - RNA, 1410 nt, Artificial Sequence
  derived and/or modified sequence opt4 from neuraminidase__InfluenzaA__BAF47953
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178601 - RNA, 1410 nt, Artificial Sequence; identical to SEQ ID NO: 178553
  derived and/or modified sequence opt4 from neuraminidase__InfluenzaA__BAF47954

SEQ ID NO: 178602 - RNA, 1410 nt, Artificial Sequence; identical to SEQ ID NO: 178553
  derived and/or modified sequence opt4 from neuraminidase__InfluenzaA__BAF47955

SEQ ID NO: 178603 - RNA, 1410 nt, Artificial Sequence
  derived and/or modified sequence opt4 from neuraminidase__InfluenzaA__BAF47956
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaacuucaugcccaucuga

SEQ ID NO: 178604 - RNA, 1410 nt, Artificial Sequence
  derived and/or modified sequence opt4 from neuraminidase__InfluenzaA__BAF47958
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugaugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggaccgacggcgccgacaucaacuucaugcccaucuga

SEQ ID NO: 178605 - RNA, 1410 nt, Artificial Sequence
  derived and/or modified sequence opt4 from neuraminidase__InfluenzaA__BAF47959
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacuacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178606 - RNA, 1410 nt, Artificial Sequence
  derived and/or modified sequence opt4 from neuraminidase__InfluenzaA__BAF47960
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178607 - RNA, 1410 nt, Artificial Sequence
  derived and/or modified sequence opt4 from neuraminidase__InfluenzaA__BAF47975
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagagacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccacaugcccaucuga

SEQ ID NO: 178608 - RNA, 1410 nt, Artificial Sequence; identical to SEQ ID NO: 167232
  derived and/or modified sequence opt4 from neuraminidase__InfluenzaA__BAF47976

SEQ ID NO: 178609 - RNA, 1410 nt, Artificial Sequence
  derived and/or modified sequence opt4 from neuraminidase__InfluenzaA__BAF47977
augaaccccaaccagaagaucaucaccaucggcagcgugagccugaccaucagcaccaucugcuucuucaugcagaucgccauccugaucaccaccgugacccugcaguucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178610 - RNA, 1410 nt, Artificial Sequence
  derived and/or modified sequence opt4 from neuraminidase__InfluenzaA__BAF47978
augaaccccaaccagaagaucaucaccaucggcagcgugagccugaccaucagcaccaucugcuucuucaugcagaucgccauccuggugaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacgccuggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178611 - RNA, 1410 nt, Artificial Sequence
  derived and/or modified sequence opt4 from neuraminidase__InfluenzaA__BAF47979
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaccaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178612 - RNA, 1410 nt, Artificial Sequence; identical to SEQ ID NO: 169084
  derived and/or modified sequence opt4 from neuraminidase__InfluenzaA__BAF47980

SEQ ID NO: 178613 - RNA, 1410 nt, Artificial Sequence
  derived and/or modified sequence opt4 from neuraminidase__InfluenzaA__BAF47981
augaaccccaaccagaagaucaucaccaucggcagcgugagccugaccaucagcaccaucugccuguucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178614 - RNA, 1410 nt, Artificial Sequence
  derived and/or modified sequence opt4 from neuraminidase__InfluenzaA__BAF47982
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaaguggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugagaaacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178615 - RNA, 1410 nt, Artificial Sequence; identical to SEQ ID NO: 169084
  derived and/or modified sequence opt4 from neuraminidase__InfluenzaA__BAF47983

SEQ ID NO: 178616 - RNA, 1410 nt, Artificial Sequence
  derived and/or modified sequence opt4 from neuraminidase__InfluenzaA__BAF47984
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcgaccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178617 - RNA, 1410 nt, Artificial Sequence
  derived and/or modified sequence opt4 from neuraminidase__InfluenzaA__BAF47985
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178618 - RNA, 1410 nt, Artificial Sequence
  derived and/or modified sequence opt4 from neuraminidase__InfluenzaA__BAF47986
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaagauucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178619 - RNA, 1410 nt, Artificial Sequence
  derived and/or modified sequence opt4 from neuraminidase__InfluenzaA__BAF47987
augaaccccaaccagaagaucaucaccaucggcagcgugagccugaccaucagcaccaucugcuucuucaugcagaucgccauccugaucaccaccgugacccugcacuucaagcaguacgaguucaacuucccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaaggugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178620 - RNA, 1410 nt, Artificial Sequence; identical to SEQ ID NO: 167234
  derived and/or modified sequence opt4 from neuraminidase__InfluenzaA__BAF47988

SEQ ID NO: 178621 - RNA, 1410 nt, Artificial Sequence; identical to SEQ ID NO: 167234
  derived and/or modified sequence opt4 from neuraminidase__InfluenzaA__BAF47989

SEQ ID NO: 178622 - RNA, 1410 nt, Artificial Sequence
  derived and/or modified sequence opt4 from neuraminidase__InfluenzaA__BAF47990
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccgugaucaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccgugagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178623 - RNA, 1410 nt, Artificial Sequence
  derived and/or modified sequence opt4 from neuraminidase__InfluenzaA__BAF47991
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaucgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcaucagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178624 - RNA, 1410 nt, Artificial Sequence
  derived and/or modified sequence opt4 from neuraminidase__InfluenzaA__BAF47992
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgagcccgacaagugcuaccccuucgcccuggugcagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcggccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcuucgugguguucugcggcaccagcggcaccuacggcaccggcagcuggcccgacggcgccgacaucaaccugaugcccaucuga

SEQ ID NO: 178625 - RNA, 1410 nt, Artificial Sequence; identical to SEQ ID NO: 178581
  derived and/or modified sequence opt4 from neuraminidase__InfluenzaA__BAF47993

SEQ ID NO: 178626 - RNA, 1410 nt, Artificial Sequence; identical to SEQ ID NO: 167232
  derived and/or modified sequence opt4 from neuraminidase__InfluenzaA__BAF47994

SEQ ID NO: 178627 - RNA, 1410 nt, Artificial Sequence
  derived and/or modified sequence opt4 from neuraminidase__InfluenzaA__BAF47995
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178628 - RNA, 1410 nt, Artificial Sequence; identical to SEQ ID NO: 178627
  derived and/or modified sequence opt4 from neuraminidase__InfluenzaA__BAF47996

SEQ ID NO: 178629 - RNA, 1410 nt, Artificial Sequence; identical to SEQ ID NO: 167234
  derived and/or modified sequence opt4 from neuraminidase__InfluenzaA__BAF47997

SEQ ID NO: 178630 - RNA, 1410 nt, Artificial Sequence
  derived and/or modified sequence opt4 from neuraminidase__InfluenzaA__BAF57504
augaaccccaaccagaagaucaucaccaucggcagcgugagccugaccaucagcaccaucugcuucuucaugcagaucgccauccugaucaccaccgugacccugcacuucaagcaguacgaguucaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcagcgaccccgacaagugcuaccaguucgcccugggccagggcaccacccugaacaacgugcacagcaacgacaccgugcacgacagaacccccuacagaacccugcugaugaaggagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcguggugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178631 - RNA, 1410 nt, Artificial Sequence
  derived and/or modified sequence opt4 from neuraminidase__InfluenzaA__BAF57508
augaaccccaaccagaagaucaucaccaucggcagcgugagccugaccaucagcaccaucugcuucuucaugcagaucgccauccugaucaccacccugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178632 - RNA, 1410 nt, Artificial Sequence; identical to SEQ ID NO: 168449
  derived and/or modified sequence opt4 from neuraminidase__InfluenzaA__BAF57511

SEQ ID NO: 178633 - RNA, 1410 nt, Artificial Sequence
  derived and/or modified sequence opt4 from neuraminidase__InfluenzaA__BAF57515
augaaccccaaccagagaaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaaggugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuaccugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagccaccccaacagccagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178634 - RNA, 1410 nt, Artificial Sequence
  derived and/or modified sequence opt4 from neuraminidase__InfluenzaA__BAF57522
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaucaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagaagcagaagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaaccggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178635 - RNA, 1410 nt, Artificial Sequence
  derived and/or modified sequence opt4 from neuraminidase__InfluenzaA__BAF57529
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaaggugcacgagagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178636 - RNA, 1410 nt, Artificial Sequence; identical to SEQ ID NO: 174071
  derived and/or modified sequence opt4 from neuraminidase__InfluenzaA__BAF57532

SEQ ID NO: 178637 - RNA, 1410 nt, Artificial Sequence; identical to SEQ ID NO: 174071
  derived and/or modified sequence opt4 from neuraminidase__InfluenzaA__BAF57536

SEQ ID NO: 178638 - RNA, 1410 nt, Artificial Sequence
  derived and/or modified sequence opt4 from neuraminidase__InfluenzaA__BAF57539
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugaucgacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggagaagaccgaggugcuguggaccagcaacagcaucgugguguucugcggcaccagcggcaccuacggcaccggcagcuggcccgacggcgccgacaucaaccugaugcccaucuga

SEQ ID NO: 178639 - RNA, 1410 nt, Artificial Sequence
  derived and/or modified sequence opt4 from neuraminidase__InfluenzaA__BAF57543
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcgccaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178640 - RNA, 1410 nt, Artificial Sequence
  derived and/or modified sequence opt4 from neuraminidase__InfluenzaA__BAF57547
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggcccuguggaccagcaacagcaucgugguguucugcggcaccagcggcaccuacggcaccggcagcuggcccgacggcgccgacaucaaccugaugcccaucuga

SEQ ID NO: 178641 - RNA, 1410 nt, Artificial Sequence; identical to SEQ ID NO: 167234
  derived and/or modified sequence opt4 from neuraminidase__InfluenzaA__BAF57551

SEQ ID NO: 178642 - RNA, 1410 nt, Artificial Sequence; identical to SEQ ID NO: 167234
  derived and/or modified sequence opt4 from neuraminidase__InfluenzaA__BAF57555

SEQ ID NO: 178643 - RNA, 1410 nt, Artificial Sequence; identical to SEQ ID NO: 167232
  derived and/or modified sequence opt4 from neuraminidase__InfluenzaA__BAF57559

SEQ ID NO: 178644 - RNA, 1410 nt, Artificial Sequence
  derived and/or modified sequence opt4 from neuraminidase__InfluenzaA__BAF57563
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaucgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178645 - RNA, 1410 nt, Artificial Sequence; identical to SEQ ID NO: 167232
  derived and/or modified sequence opt4 from neuraminidase__InfluenzaA__BAF57571

SEQ ID NO: 178646 - RNA, 1410 nt, Artificial Sequence; identical to SEQ ID NO: 173976
  derived and/or modified sequence opt4 from neuraminidase__InfluenzaA__BAF57575

SEQ ID NO: 178647 - RNA, 1410 nt, Artificial Sequence; identical to SEQ ID NO: 166847
  derived and/or modified sequence opt4 from neuraminidase__InfluenzaA__BAF57579

SEQ ID NO: 178648 - RNA, 1410 nt, Artificial Sequence
  derived and/or modified sequence opt4 from neuraminidase__InfluenzaA__BAF57583
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucagagugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178649 - RNA, 1410 nt, Artificial Sequence
  derived and/or modified sequence opt4 from neuraminidase__InfluenzaA__BAF57587
augaaccccaaccagaagaucaucaccaucggcagcgugagccugaccaucagcaccaucugcuucuucaugcagaucgccauccugaucaccaccgugacccugcacuucaagcagugcgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178650 - RNA, 1410 nt, Artificial Sequence
  derived and/or modified sequence opt4 from neuraminidase__InfluenzaA__BAF57591
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucgugcacaucaacaucaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagacugggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178651 - RNA, 1410 nt, Artificial Sequence
  derived and/or modified sequence opt4 from neuraminidase__InfluenzaA__BAF57595
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagaucgccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcgugaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccaacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgacaucaaccugaugcccaucuga

SEQ ID NO: 178652 - RNA, 1410 nt, Artificial Sequence; identical to SEQ ID NO: 173976
  derived and/or modified sequence opt4 from neuraminidase__InfluenzaA__BAF57599

SEQ ID NO: 178653 - RNA, 1410 nt, Artificial Sequence
  derived and/or modified sequence opt4 from neuraminidase__InfluenzaA__BAF57603
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaccccgacagcaagcugcagaucaacagacaggugaucguggacagaggcaacagaagcggcuacagcggcaucuucagcguggagggcaagagcugcaucaacagaugcuucuacguggagcugaucagaggcagaaaggaggagaccgaggugcugggcaccagcaacagcaucgugguguucugcggcaccagcggcaccuacggcaccggcagcuggcccgacggcgccgacaucaaccugaugcccaucuga

SEQ ID NO: 178654 - RNA, 1410 nt, Artificial Sequence; identical to SEQ ID NO: 174071
  derived and/or modified sequence opt4 from Neuraminidase__InfluenzaA__BAF62620

SEQ ID NO: 178655 - RNA, 1413 nt, Artificial Sequence
  derived and/or modified sequence opt4 from neuraminidase__InfluenzaA__BAF63036
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaccaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178656 - RNA, 1413 nt, Artificial Sequence; identical to SEQ ID NO: 173961
  derived and/or modified sequence opt4 from neuraminidase__InfluenzaA__BAF63040

SEQ ID NO: 178657 - RNA, 1413 nt, Artificial Sequence
  derived and/or modified sequence opt4 from neuraminidase__InfluenzaA__BAF63047
augaaccccaaccagaagaucaucaccaucggcagcaucagcaucgccaucggcaucaucagccuggugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccgacuggagcuggcccgacggcgccgagcugcccuucaccaucgacaaguga

SEQ ID NO: 178658 - RNA, 1413 nt, Artificial Sequence
  derived and/or modified sequence opt4 from neuraminidase__InfluenzaA__BAF63058
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcgccaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacgaggccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccccaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagauggugugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 178659 - RNA, 1413 nt, Artificial Sequence; identical to SEQ ID NO: 173961
  derived and/or modified sequence opt4 from neuraminidase__InfluenzaA__BAF63065

SEQ ID NO: 178660 - RNA, 1413 nt, Artificial Sequence; identical to SEQ ID NO: 173961
  derived and/or modified sequence opt4 from neuraminidase__InfluenzaA__BAF63069

SEQ ID NO: 178661 - RNA, 1413 nt, Artificial Sequence; identical to SEQ ID NO: 173961
  derived and/or modified sequence opt4 from neuraminidase__InfluenzaA__BAF63079

SEQ ID NO: 178662 - RNA, 1413 nt, Artificial Sequence; identical to SEQ ID NO: 173961
  derived and/or modified sequence opt4 from neuraminidase__InfluenzaA__BAF63092

SEQ ID NO: 178663 - RNA, 1413 nt, Artificial Sequence; identical to SEQ ID NO: 173961
  derived and/or modified sequence opt4 from neuraminidase__InfluenzaA__BAF63098

SEQ ID NO: 178664 - RNA, 1413 nt, Artificial Sequence
  derived and/or modified sequence opt4 from neuraminidase__InfluenzaA__BAF63104
augaaccccaaccagaagaucaucaccaucggcagcaucagcaucgccaucggcaucaucagccugaugcugcaggugggcaucguggugagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcguggcccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggccaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 178665 - RNA, 1413 nt, Artificial Sequence
  derived and/or modified sequence opt4 from neuraminidase__InfluenzaA__BAF63112
augaaccccaaccagaagaucaucaccaucggcagcaucagcaucgccaucggcaucaucagccugaugcugcaggugggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcguggcccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggccaggugaccaagagcguggagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 178666 - RNA, 1413 nt, Artificial Sequence
  derived and/or modified sequence opt4 from neuraminidase__InfluenzaA__BAF63116
augaaccccaaccagaagaucaucaccaucggcagcaucagcaucgccaucggcaucaucagccugaugcugcaggugggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcguggcccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggccaggugaccaagagcguggagcugaacgcccccaacuuccacuacgaggagugcagcugcuaccccgacaccggcaccgugaugugcgugugcagagacaacuggcacggcagcaacagacccugggugagcuucaaccccgaccuggacuaccagaucggcuacaucugcagcggcguguucggcgacaaccccagacccaaggacggcaagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 178667 - RNA, 1413 nt, Artificial Sequence
  derived and/or modified sequence opt4 from neuraminidase__InfluenzaA__BAF63124
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcagagagcugaacgcccccaacuuccacuacgaggagugcagcugcuaccccgacaccggcaccgugaugugcgugugcagagacaacuggcacggcagcaacagacccugggugagcuucaaccccaaccuggacuaccagaucggcuacaucugcagcggcguggugggcgacaaccccagacccaaggacggcaagggcagcugcaaccccgugaccgccgacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcguggacagcgacaccgccaacuggagcuggcccgacggcgccgagcugcccuucaccaucgacaaguga

SEQ ID NO: 178668 - RNA, 1413 nt, Artificial Sequence; identical to SEQ ID NO: 174023
  derived and/or modified sequence opt4 from neuraminidase__InfluenzaA__BAF63132

SEQ ID NO: 178669 - RNA, 1413 nt, Artificial Sequence
  derived and/or modified sequence opt4 from neuraminidase__InfluenzaA__BAF63136
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcaagaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccggcaccaucaagagcuggaagaagcagauccugagaacccaggagagcgagugcgugugcaugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccaacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178670 - RNA, 1350 nt, Artificial Sequence
  derived and/or modified sequence opt4 from neuraminidase__InfluenzaA__BAH24021
augaaccccaaccagaagaucaucaccaucggcagcaucugcauggugaucggcaucgugagccugaugcugcagaucggcaacauggugagccugugggugagccacagcauccagaccggcaaccagcaccagguggagcccaucagcaacaccaacuuccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaugaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacggcggcaccggcagcugcggccccgugagccccaacggcgccuacggcgugaagggcuucagcuucaaguacggcaacggcguguggaucggcagaaccaagagccccagcagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178671 - RNA, 1410 nt, Artificial Sequence; identical to SEQ ID NO: 169413
  derived and/or modified sequence opt4 from neuraminidase__InfluenzaA__BAH95825

SEQ ID NO: 178672 - RNA, 1410 nt, Artificial Sequence; identical to SEQ ID NO: 169248
  derived and/or modified sequence opt4 from neuraminidase__InfluenzaA__BAH95826

SEQ ID NO: 178673 - RNA, 1410 nt, Artificial Sequence
  derived and/or modified sequence opt4 from neuraminidase__InfluenzaA__BAJ07994
augaaccccaaccagaagaucaccaccaucggcagcaucugcauggugaucggcaucgugagccugaugcugcagaucggcaacaucaucagcaucugggugagccacagcauccagaccggcaaccagcaccaggccgagcccugcaaccagagcaucaucaccuacgagaacaacaccugggugaaccagaccuacgugaacaucagcaacaccaacuuccugaccgagaaggccguggccagcgugacccuggccggcaacagcagccugugccccaucagcggcugggccguguacagcaaggacaacggcaucagaaucggcagcaagggcgacguguucgugaucagagagcccuucaucagcugcagccaccuggagugcagaaucuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacaucaugagaacccaggagagcgagugcgccugcgugaacggcagcugcuucaccgugaugaccgacggccccagcaacggccaggccagcuacaagaucuucagaaucgagaagggcaagguggugaagagcgccgagcugaacgcccccaacuaccacuacgaggagugcagcugcuaccccgacgccggcgagaucaccugcgugugcagagacaacuggcacggcagcaacagacccugggugagcuucaaccagaaccuggaguacagaaucggcuacaucugcagcggcguguucggcgacaaccccagacccaacgacggcaccggcagcugcggccccgugagccccaagggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 178674 - RNA, 1350 nt, Artificial Sequence
  derived and/or modified sequence opt4 from neuraminidase__InfluenzaA__BAK23415
augaaccccaaccagaagaucaucaccaucggcagcgugugcaugaucaucggcaucgugagccugaugcugcagaucggcaacaugaucagcaucugggugggccacagcauccagaccggcaaccagugccacgccgagcccaucagcaacaccaaguuccccaccgagaaggccgccgccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcaucaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178675 - RNA, 1350 nt, Artificial Sequence
  derived and/or modified sequence opt4 from neuraminidase__InfluenzaA__BAK23416
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgccagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178676 - RNA, 1350 nt, Artificial Sequence
  derived and/or modified sequence opt4 from neuraminidase__InfluenzaA__BAK23417
augaaccccaaccagaagaucaucaccaucggcagcaucugcauggugaucggcaucgugagccugaugcugcagaucggcaacaugaucagcaucugggugagccacagcauccagaccggcaaccagugccagagcgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 178677 - RNA, 1350 nt, Artificial Sequence
  derived and/or modified sequence opt4 from neuraminidase__InfluenzaA__BAK23418
augaaccccaaccagaccaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178678 - RNA, 1350 nt, Artificial Sequence; identical to SEQ ID NO: 169097
  derived and/or modified sequence opt4 from neuraminidase__InfluenzaA__BAK23420

SEQ ID NO: 178679 - RNA, 1350 nt, Artificial Sequence; identical to SEQ ID NO: 169097
  derived and/or modified sequence opt4 from neuraminidase__InfluenzaA__BAK23421

SEQ ID NO: 178680 - RNA, 1350 nt, Artificial Sequence
  derived and/or modified sequence opt4 from neuraminidase__InfluenzaA__BAK23422
augaaccccaaccagaagaucaucaccaucggcagcgugugcauggugaucggcaucgugagccugaugcugcagaucggcaacaugaucagcaucugggugggccacagcauccagaccggcaaccagugccacgccgagcccaucagcaacaccaaguuccccaccgagaaggccgccgccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178681 - RNA, 1350 nt, Artificial Sequence
  derived and/or modified sequence opt4 from neuraminidase__InfluenzaA__BAK23423
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaccaccaaguuccugaccgagaaggccguggccagcgugacccuggccggcaacagcagccugugccccaucagcggcugggccguguacagcaaggacaacagcaucagaaucggccccagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178682 - RNA, 1350 nt, Artificial Sequence
  derived and/or modified sequence opt4 from neuraminidase__InfluenzaA__BAK23424
augaaccccaaccagaagaucaucaccaucggcagcaucugcauggugaucggcaucgugagccugaugcugcagaucggcaacaugaucagcaucugggugagccacagcauccagaccggcaaccagugccagggcgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccguguucagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcggcaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178683 - RNA, 1350 nt, Artificial Sequence
  derived and/or modified sequence opt4 from neuraminidase__InfluenzaA__BAK23425
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaucggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178684 - RNA, 1350 nt, Artificial Sequence
  derived and/or modified sequence opt4 from neuraminidase__InfluenzaA__BAK23426
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguucuucaccgagaaggccguggccagcgugacccuggccggcaacagcagccugugccccaucagcggcugggccguguacagcaaggacaacagcaucagaaucggcagcagaggcgacguguucaucaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178685 - RNA, 1350 nt, Artificial Sequence; identical to SEQ ID NO: 178683
  derived and/or modified sequence opt4 from neuraminidase__InfluenzaA__BAK23427

SEQ ID NO: 178686 - RNA, 1350 nt, Artificial Sequence
  derived and/or modified sequence opt4 from neuraminidase__InfluenzaA__BAK23428
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcgugagcgugaagcaggacaucguggccaucaccgacuggagcggcuacagcggcagcuucgugcagcaccccgagcugaccggccuggacugcaucagacccugcuucagaguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178687 - RNA, 1350 nt, Artificial Sequence; identical to SEQ ID NO: 178683
  derived and/or modified sequence opt4 from neuraminidase__InfluenzaA__BAK23429

SEQ ID NO: 178688 - RNA, 1350 nt, Artificial Sequence
  derived and/or modified sequence opt4 from neuraminidase__InfluenzaA__BAK23430
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaucggcaccgacagcagcuucagcgugaagcaggacaucguggccaucaccgacuggagcggcuacagcggcagcuucgugcagcaccccgagcugaccggccuggacugcaugagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178689 - RNA, 1350 nt, Artificial Sequence
  derived and/or modified sequence opt4 from neuraminidase__InfluenzaA__BAK23431
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucuggggccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178690 - RNA, 1350 nt, Artificial Sequence; identical to SEQ ID NO: 178683
  derived and/or modified sequence opt4 from neuraminidase__InfluenzaA__BAK23432

SEQ ID NO: 178691 - RNA, 1350 nt, Artificial Sequence; identical to SEQ ID NO: 178683
  derived and/or modified sequence opt4 from neuraminidase__InfluenzaA__BAK23433

SEQ ID NO: 178692 - RNA, 1410 nt, Artificial Sequence
  derived and/or modified sequence opt4 from neuraminidase__InfluenzaA__BAM65748
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcgacaucaccggcuucgcccccuucagcaaggacaacagcaucagacugagcgccggcggcgacaucugggugaccagagagcccuacgugagcugcgaccccgacaagugcuuccaguucgcccugggccagggcaccacccugaacaacgugcacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucgugagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaccgacagcagcagcagcagccacugccuggaccccaacaacgaggagggcggccacggcgugaagggcugggccuucgacgacggcaacgacguguggaugggcagaaccaucagcgagaagagcagacugggcuacgagaccuucaaggugaucggcggcuggagcaaccccaacagcaagagccagaucaacagacaggugaucguggacaugggcaacagaagcggcuacagcggcaucuucagcguggagggcaagagcugcaucaacagaugcuucuacguggagcugaucagaggcagaaaggacgagaccgaggugcuguggaccagcaacagcaucgugguguucugcggcaccagcggcaccuacggcaccggcagcuggcccgacggcgccgacaucaagcugaugagcaucuga

SEQ ID NO: 178693 - RNA, 1350 nt, Artificial Sequence
  derived and/or modified sequence opt4 from neuraminidase__InfluenzaA__BAM85817
augaaccccaaccagaagaucaucaccaucggcagcaucugcauggugaccggcaucgugagccugaugcugcagaucggcaacaugaucagcaucugggugagccacagcauccacaccggcaaccagcaccagagcgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagccacaagaucuucaagauggagaagggcaagguggugaagagcguggagcuggacgcccccaacuaccacuacgaggagugcagcugcuaccccaacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 178694 - RNA, 1350 nt, Artificial Sequence
  derived and/or modified sequence opt4 from neuraminidase__InfluenzaA__BAM85818
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178695 - RNA, 1350 nt, Artificial Sequence
  derived and/or modified sequence opt4 from neuraminidase__InfluenzaA__BAM85819
augaaccccaaccagaagaucaucaccaucggcagcaucugcauggugaucggcaucgugagccugaugcugcagaucggcaacaugaucagcaucugggugagccacagcauccagaccggcaaccagaaccagguggagcccaucaucaacaccaacuuccugaccgagaaggccguggccagcaucacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccacaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugagcagcgacaccgugagcuggagcuggcccgacggcgccgagcugcccuucaccaucgacaaguga

SEQ ID NO: 178696 - RNA, 1350 nt, Artificial Sequence
  derived and/or modified sequence opt4 from neuraminidase__InfluenzaA__BAM85820
augaaccccaaccagaagaucaucaccaucggcagcaucugcauggugaucggcaucgugagccugaugcugcagaucggcaacaugaucagcaucugggugagccacagcauccagaccggcaaccagcaccaggccgagcccaucagcaacaccaacuuccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178697 - RNA, 1350 nt, Artificial Sequence; identical to SEQ ID NO: 167528
  derived and/or modified sequence opt4 from neuraminidase__InfluenzaA__BAM85821

SEQ ID NO: 178698 - RNA, 1350 nt, Artificial Sequence
  derived and/or modified sequence opt4 from neuraminidase__InfluenzaA__BAM85822
augaaccccaaccagaagaucaucaccaucggcagcaucugcauggugaccggcaucgugagccugaugcugcagaucggcaacaugaucagcaucugggugagccacagcauccacaccggcaaccagcaccagagcgagcccaucagcaacaccaacuuccugaccgagaaggccguggccagcgugaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgccugcgugaacggcagcugcuucaccgugaugaccgacggccccagcaacagccaggccagccacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 178699 - RNA, 1410 nt, Artificial Sequence
  derived and/or modified sequence opt4 from neuraminidase__InfluenzaA__BAM85823
augaaccccaaccagaagaucaccaccaucggcagcaucugcauggugaucggcaucgugagccugaugcugcagaucggcaacaucaucagcaucugggugagccacagcauccagaccggcaaccagcaccaggccggccccugcaaccagagcaucaucaccuacgagaacaacaccugggugaaccagaccuacgugaacaucagcaacaccaacuuccugaccgagaagaccguggccagcgugacccuggccggcaacagcagccugugccccaucagcggcugggccguguacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcaacggccaggccagcuacaagaucuucagaaucgagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcaucuucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcaacuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 178700 - RNA, 1350 nt, Artificial Sequence
  derived and/or modified sequence opt4 from neuraminidase__InfluenzaA__BAM85824
augaaccccaaccagaagaucaucaccaucggcagcaucugcauggugaucggcaucgugagccugcugcugcagaucggcaacaugaucagcaucuggaucagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccagcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccauguuccccaacggcgccuacggcaucaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178701 - RNA, 1350 nt, Artificial Sequence
  derived and/or modified sequence opt4 from neuraminidase__InfluenzaA__BAM85825
augaaccccaaccagaagaucaucaccaucggcagcaucugcauggugaucggcaucgugagccugaugcugcagaucggcaacaugaucagcaucugggugagccacagcauccagaccggcaaccagaaccagguggagcccaucaucaacaccaacuuccugaccgagaaggccguggccagcaucacccuggccggcaacagcagccugugccccaucagaggcugggccauccacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccacaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccguguggaccagcggcagcagcaucagcuucugcggcgugaacagcgacaccgugagcuggagcuggcccgacggcgccgagcugcccuucaccaucgacaaguga

SEQ ID NO: 178702 - RNA, 1350 nt, Artificial Sequence
  derived and/or modified sequence opt4 from neuraminidase__InfluenzaA__BAM85826
augaaccccaaccagaagaucaucaccaucggcagcaucugcauggugaucggcaucgugagccugaugcugcagaucggcaacaugaucagcaucugggugagccacagcauccagaccggcaaccagagacaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccugaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178703 - RNA, 1350 nt, Artificial Sequence
  derived and/or modified sequence opt4 from neuraminidase__InfluenzaA__BAM85827
augaaccccaaccagaagaucaucaccaucggcagcaucugcauggugaucggcguggugagccugaugcugcagaccggcaacaucaucagcaucugggugagccacagcauccagaagggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaccagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcguggacagcgacaccgugagcuggagcuggcccgacggcgccgagcugcccuucaccaucgacaaguga

SEQ ID NO: 178704 - RNA, 1350 nt, Artificial Sequence
  derived and/or modified sequence opt4 from neuraminidase__InfluenzaA__BAM85828
augaaccccaaccagaagaucaucaccaucggcagcaucugcauggugaucggcaucgugagccugaugcugcagaucggcaacaugaucagcaucugggugagccacagcauccagaccggcaaccagagacaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178705 - RNA, 1350 nt, Artificial Sequence
  derived and/or modified sequence opt4 from neuraminidase__InfluenzaA__BAM85829
augaaccccaaccagaagaucaucaccaucggcagcaucugcaugaucaucggcaucgugagccugaugcugcagaucggcaacaucaucagcaucugggugagccacagcauccagaccggcaaccagcaccaggccgagcccaucagcgacaccaacuuccugaccgagaaggccguggccagcgugauccuggccggcaacagcagccugugccacaucagcggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacuacauccugagaacccaggagagcgagugcgccugcgugaacggcagcugcuucaccgugaugaccgacggccccagcaacggccaggccagcuacaagaucuucaagaucgagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacacccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggaccugguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgagcugcccuucaccaucgacaaguga

SEQ ID NO: 178706 - RNA, 1413 nt, Artificial Sequence
  derived and/or modified sequence opt4 from neuraminidase__InfluenzaA__BAM85830
augaaccccaaccagaagaucaucaccaucggcagcaucugcauggccaucggcaccaucagccugauccugcagaucggcaacaucaucagcaucuggaucagccacagcauccagaccggcagccagaaccacaccggcaucugcaaccagagaaucaucaccuacgagaacaacaccugggugaaccagaccuacgugaacaucagcaacaccaacgugguggccggcaaggacaccaccagcaugauccuggccggcaacagcagccugugccccaucagaggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugccccaucggcgaggcccccagccccuacaacagcagauucgagagcguggccuggagcgccagcgccugccacgacggcaugggcuggcugaccaucggcaucagcggccccgacgacggcgccguggccgugcugaaguacaacggcaucaucaccgagaucaucaagagcuggagaaagcagauccugagaacccaggagagcgagugcgugugcgugaacggcagcugcuucaccaucaugaccgacggccccagcaacggccccgccagcuacagaaucuucaagaucaagaagggcaagaucaccaagagcaucgagcuggacgcccccaacagccacuacgaggagugcagcugcuaccccgacaccggcaaggugaugugcgugugcagagacaacuggcacggcagcaacagacccugggugagcuucaaccagaaccuggacuaccagaucggcuacaucugcagcggcguguucggcgacaaccccagacccaaggacggcaagggcagcugcgaccccgugaacguggacggcgccgacggcgugaagggcuucagcuacagauacggcaacggcguguggaucggcagaaccaagagcaacagcagcagaaagggcuucgagaugaucugggaccccaacggcuggaccgacaccgacggcaacuuccuggugaagcaggacgugguggccaugaccgacuggagcggcuacagcggcagcuucgugcagcaccccgagcugaccggccuggacugcaugagacccugcuucuggguggagcugaucagaggccagcccagagagaagaccaccaucuggaccagcggcagcagcaucagcuucugcggcgugaacagcgacaccgugaacuggagcuggcccgacggcgccgagcugcccuucaccaucgacaaguga

SEQ ID NO: 178707 - RNA, 1413 nt, Artificial Sequence
  derived and/or modified sequence opt4 from neuraminidase__InfluenzaA__BAM85831
augaaccccaaccagaagaucaucaccaucggcagcaucagcaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaucggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccagagacggcgagggcagcugcaaccccgugaccgccgacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccugggcugcaucagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178708 - RNA, 1413 nt, Artificial Sequence; identical to SEQ ID NO: 174028
  derived and/or modified sequence opt4 from neuraminidase__InfluenzaA__BAM85832

SEQ ID NO: 178709 - RNA, 1410 nt, Artificial Sequence
  derived and/or modified sequence opt4 from neuraminidase__InfluenzaA__BAM85833
augaaccccaaccagaagaucaucaccaucggcagcaccugcauggugaucggcaucaucagccugauccugcagaucggcaacaucaucagcaucugggugagccacagcauccagaccggcaaccagaaccagcccgagaccugcaaccagagcgugaucaccuacgagaacaagaccugggugaaccagaccuacgugaacaucagcaacaccaaccuggugaucgagagagacgugaucagcguggcccugcugggcaacagcagccugugccccaucagcggcugggccaucuacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaucagcuggcugaccgugggcaucagcggccccgacaacggcgccguggccgugcugaaguacaacggcaucaucaccgacaccgugaagagcuggagaaacaacauccugagaacccaggagagcgagugcgccugcaucaacggcagcugcuucaccaucaugaccgacggccccagcaacggccaggccagcuacaagaucuucaagaucgagaagggcaagguggugaagagcguggagcugaacgcccccaacuaccacuacgaggagugcagcugcuaccccgacgccagcgagaucaugugcgugugcagagacaacuggcacggcagcaacagacccugggugagcuucaacagaaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaagggcguguggaucggcagaaccaagagcaccagcagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178710 - RNA, 1410 nt, Artificial Sequence
  derived and/or modified sequence opt4 from neuraminidase__InfluenzaA__BAM85834
augaaccccaaccagaagaucaucaccaucggcagcgugagccugaccguggccaccgugugcuuccugaugcagaucgccauccugaccaccaccgugacccugcacuucaagcagaacgagugcagcauccccgccaacaaccaggugaugcccugcgagcccaucgugaucgagagaaacaucaccgagaucguguaccugaacaacaccaccaucgagaaggagaucugccugaaggccgccgaguacagaaacuggagcaagccccagugccagaucaccggcuucgcccccuucagcaaggacaacagcaucagacugagcgccggcggcgacaucugggugaccagagagcccuacgugagcugcgaccccagcaagugcuaccaguucgcccugggccagggcaccacccuggagaacaagcacagcaacggcaccauccacgacagaaucccccacagaacccugcugaugaacgagcugggcgugcccuuccaccugggcaccaagcaggugugcaucgccuggagcagcagcagcugccacgacggcaaggccuggcugcacgugugcgugaccggcgacgacagaaacgccaccgccagcuucaucuacgacggcaugcugguggacagcaucggcagcuggagccagaacauccugagaacccaggagagcgagugcgugugcaucaacggcaccugcgccguggugaugaccgacggcagcgccagcggcagagccgacaccagaauccuguucaucagagagggcaagaucgugcacaucagcccccugagcggcagcgcccagcacaucgaggagugcagcugcuaccccagauaccccaucaucagaugcgugugcagagacaacuggaagggcagcaacagacccgugaucgacaucaacauggccgacuacagcaucgacagcagcuacgugugcagcggccuggugggcgacacccccagaaacgacgacagcagcagcagcagcaacugcagagaccccaacaacgagagaggcaaccccggcgugaagggcugggccuucgacaacggcaacgacguguggaugggcagaaccaucagcaaggacagcagaagcggcuacgagaccuucagagugaucggcggcugggccaccgccaacagcaagagccagaccaacagacaggugaucguggacaacaacaacuggagcggcuacagcggcaucuucagcguggagagcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 178711 - RNA, 1410 nt, Artificial Sequence
  derived and/or modified sequence opt4 from neuraminidase__InfluenzaA__BAM85835
augaaccccaaccagaagaucaucaccaucggcagcgugagccugaccaucgccaccgugugcuuccugaugcagaucgccauccuggccaccaccgugacccugcacuucaagcagaacgagugcagcauccccgccaacaaccagguggugcccugcgagcccaucaucaucgagagaaacaucaccgagaucguguaccugaacaacaccaccaucgagaaggagaucugcagcaaggccguggacuacagaaacuggagcaagccccagugccagaucaccggcuucgcccccuucagcaaggacaacagcaucagacugagcgccggcggcgacaucugggugaccagagagcccuacgugagcugcgacaccagcaagugcuaccaguucgcccugggccagggcaccacccuggacaacaagcacagcaacggcaccauccacgacagaaucccccacagaacccugcugaugaacgagcugggcgugcccuuccaccugggcaccaagcaggugugcaucgccuggagcagcagcagcugccacgacggcaaggccuggcugcacgugugcgugaccggcgacgacagaaacgccaccgccagcuucaucuacaacggcaugcugguggacagcaucggcagcuggagccagaacauccugagaacccaggagagcgagugcgugugcaucaacggcagcugcaccguggugaugaccgacggcagcgccagcggcaaggccgacaccagaauccuguucgugaaggagggcaagaucauccacaucagcccccugagcggcagcgcccagcacaucgaggagugcagcugcuaccccagauaccccaacgugagaugcgugugcagagacaacuggagaggcagcaacagacccgugaucgacaucaacauggccgacuacagcaucgacagcagcuacgugugcagcggccuggugggcgacacccccagaaacgacgacaacagcagcagcagcaacugcagagaccccaacaacgagagaggcaaccccggcgugaagggcugggccuucgacagcggcgacgacguguggaugggcagaaccaucagcagagacagcagaagcggcuacgagaccuucaaggugaucggcggcugggccaccgccaacagcaagagccagaccagcagacaggugaucguggacaacaacaacuggagcggcuacagcggcguguucagcguggagcacaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 178712 - RNA, 1410 nt, Artificial Sequence
  derived and/or modified sequence opt4 from neuraminidase__InfluenzaA__BAM85836
augaaccccaaccagaagaucaucaccaucggcagcgugagccugaccaucgccaccaucugcuuccugaugcagaucgccauccuggccaccaccgugacccugcacuucaagcagaacggcugcagcauccccagcaacaaccagguggugcccugcgagcccaucaucguggagagaaacaucaccgagaucguguaccugaacaacaccaccaucgagaaggagcugugccccaaggugcuggaguacagagacuggagcaagccccagugccagaucaccggcuucgcccccuucagcaaggacaacagcaucagacugagcgccggcggcgacaucugggugaccagagagcccuacgugagcugcagccccgacaagugcuaccaguucgcccugggccagggcaccacccuggacaacagacacagcaacggcaccauccacgacagaaucccccacagaacccugcugaugaacgagcugggcgugcccuuccaccugggcaccaagcaggugugcaucgccuggagcagcagcagcugccacgacggcagagccuggcugcacgugugcgugaccggcgacgacagaaacgccaccgccagcuucaucuacgacggcaugcugguggacagcaucggcagcuggagccagaacauccugagaacccaggagagcgagugcgugugcaucaacggcaccugcaccguggugaugaccgacggcagcgccagcggcagagccgacaccagaauccuguucgugaaggagggcaagaucgugcacaucagcccccugagcggcagcgcccagcacaucgaggagugcagcugcuaccccagauaccccgacgugagaugcgugugcagagacaacuggaagggcagcaacagacccaucaucgacaucaacauggccgacuacagcaucggcagcagcuacgugugcagcggccuggugggcgacacccccagaaacgacgacagcagcagcaacagcaacugcagagaccccaacaacgagagaggcaaccccggcgugaagggcugggccuucgacuacggcaacgacguguggaugggcagaaccaucagcaaggacagcagaagcggcuacgagaccuucagagugaucggcggcuggaccaccgccaacagcaagagccaggugaacagacaggugaucguggacaacagcaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 178713 - RNA, 1410 nt, Artificial Sequence
  derived and/or modified sequence opt4 from neuraminidase__InfluenzaA__BAO79717
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagaacugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178714 - RNA, 1413 nt, Artificial Sequence; identical to SEQ ID NO: 167579
  derived and/or modified sequence opt4 from neuraminidase__InfluenzaA__CAA33354

SEQ ID NO: 178715 - RNA, 1404 nt, Artificial Sequence
  derived and/or modified sequence opt4 from Neuraminidase__InfluenzaA__CAB95858
augaaccccaaccagaagaucaucgcccugggcagcgugagcaucaccaucgccaccaucugccugcugaugcagaucgccauccuggccaccaccaugacccugcacuucaacgagugcaccaaccccagcaacaaccaggccaugcccugcgagcccaucaucaucgagagaaacaucaccgagaucgugcaccugaacaacaccaccaucgagaaggagagcugccccaagguggccgaguacaagaacuggagcaagccccagugccagaucaccggcuucgcccccuucagcaaggacaacagcaucagacugagcgccggcggcgacaucugggugaccagagagcccuacgugagcugcggccugggcaacugcuaccaguucgcccugggccagggcaccacccugaacaacaagcacagcaacggcaccauccacgacagaagcccccacagaacccugcugaugaacgagcugggcgugcccuuccaccugggcaccaagcaggugugcaucgccuggagcagcagcagcugccacgacggcaaggccuggcugcacgugugcgugaccggcgacgacagaaacgccaccgccagcaucaucuacgacggcaugcugaccgacagcaucggcagcuggagcaagaacauccugagaacccaggagagcgagugcgugugcaucaacggcaccugcaccguggugaugaccgacggcagcgccagcggcagagccgacaccaagauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguacaucaacguggccgacuacagcguggacagcagcuacgugugcagcggccuggugggcgacacccccagaaacgacgacagcagcagcagcagcaacugcagagaccccaacaacgagagaggcggccccggcgugaagggcugggccuucgacaacggcaacgacguguggaugggcagaaccaucaagaaggacagcagaagcggcuacgagaccuucagaguggugggcggcuggaccaccgccaacagcaagagccagaucaacagacaggugaucguggacagcgacaacuggagcggcuacagcggcaucuucagcguggagggcaagaccugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugagcaucuga

SEQ ID NO: 178716 - RNA, 1404 nt, Artificial Sequence
  derived and/or modified sequence opt4 from neuraminidase__InfluenzaA__CAB95859
augaaccccaaccagaagaucaucgcccugggcagcgugagcaucaccaucgccaccaucugccugcugaugcagaucgccauccuggccaccaccaugacccugcacuucaacgagugcaccaaccccagcaacaaccaggccgugcccugcgagcccaucaucaucgagagaaacaucaccgagaucgugcaccugaacaacaccaccaucgagaaggagagcugccccaagguggccgaguacaagaacuggagcaagccccagugccagaucaccggcuucgcccccuucagcaaggacaacagcaucagacugagcgccggcggcgacaucugggugaccagagagcccuacgugagcugcggccugggcaagugcuaccaguucgcccugggccagggcaccacccugaacaacaagcacagcaacggcaccauccacgacagaagcccccacagaacccugcugaugaacgagcugggcgugcccuuccaccugggcaccaagcaggugugcaucgccuggagcagcagcagcugccacgacggcaaggccuggcugcacgugugcgugaccggcgacgacagaaacgccaccgccagcaucaucuacgacggcaugcugaccgacagcaucggcagcuggagcaagaacauccugagaacccaggagagcgagugcgugugcaucaacggcaccugcaccguggugaugaccgacggcagcgccagcggcagagccgacaccaagauccuguucaucagagagggcaagaucgugcacaucggcccccugagcggcagcgcccagcacguggaggagugcagcugcuaccccagauaccccgaggugagaugcgugugcagagacaacuggaagggcagcaacagacccgugcuguacaucaacguggccgacuacagcguggacagcagcuacgugugcagcggccuggugggcgacacccccagaaacgacgacagcagcagcagcagcaacugcagagaccccaacaacgagagaggcggccccggcgugaagggcugggccuucgacaacggcaacgacguguggaugggcagaaccaucaagaaggacagcagaagcggcuacgagaccuucagaguggugggcggcuggaccaccgccaacagcaagagccagaucaacagacaggugaucguggacagcgacaacuggagcggcuacagcggcaucuucagcguggagggcaagaccugcaucaacagaugcuucuacguggagcugaucagaggcagaccccaggagaccagagugugguggaccagcaacagcaucaucguguucugcggcaccagcggcaccuacggcaccggcagcuggcccgacggcgccaacaucaacuucaugagcaucuga

SEQ ID NO: 178717 - RNA, 1410 nt, Artificial Sequence; identical to SEQ ID NO: 167093
  derived and/or modified sequence opt4 from Neuraminidase__InfluenzaA__CAC19707

SEQ ID NO: 178718 - RNA, 1410 nt, Artificial Sequence
  derived and/or modified sequence opt4 from neuraminidase__InfluenzaA__CAD29959
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178719 - RNA, 1410 nt, Artificial Sequence
  derived and/or modified sequence opt4 from neuraminidase__InfluenzaA__CAD29960
augaaccccaaccagaagaucaucaccaucggcagcgugagccugaccaucgccaccaucugcuuccugaugcagaucgccauccuggugaccaccgugacccugcacuucaagcaguacgagugcaaccccccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgugagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178720 - RNA, 1410 nt, Artificial Sequence
  derived and/or modified sequence opt4 from neuraminidase__InfluenzaA__CAD29961
augaaccccaaccagaagaucaucaccaucggcagcgugagccugaccaucagcaccaucugcuucuucaugcagaucgccauccuggugaccaccgugacccugcacuucaagcaguacgagugcaacagcccccccaacaaccaggugaugcugugcgagcccaccaucaucgagagaaacaccaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcggccccgacggcgccgacaucaaccugaugcccaucuga

SEQ ID NO: 178721 - RNA, 1410 nt, Artificial Sequence; identical to SEQ ID NO: 174065
  derived and/or modified sequence opt4 from neuraminidase__InfluenzaA__CAD29962

SEQ ID NO: 178722 - RNA, 1410 nt, Artificial Sequence; identical to SEQ ID NO: 166804
  derived and/or modified sequence opt4 from neuraminidase__InfluenzaA__CAD29963

SEQ ID NO: 178723 - RNA, 1410 nt, Artificial Sequence; identical to SEQ ID NO: 166804
  derived and/or modified sequence opt4 from neuraminidase__InfluenzaA__CAD29964

SEQ ID NO: 178724 - RNA, 1410 nt, Artificial Sequence; identical to SEQ ID NO: 166804
  derived and/or modified sequence opt4 from neuraminidase__InfluenzaA__CAD29965

SEQ ID NO: 178725 - RNA, 1410 nt, Artificial Sequence; identical to SEQ ID NO: 166804
  derived and/or modified sequence opt4 from neuraminidase__InfluenzaA__CAD29966

SEQ ID NO: 178726 - RNA, 1410 nt, Artificial Sequence; identical to SEQ ID NO: 166560
  derived and/or modified sequence opt4 from neuraminidase__InfluenzaA__CAD29967

SEQ ID NO: 178727 - RNA, 1410 nt, Artificial Sequence; identical to SEQ ID NO: 166560
  derived and/or modified sequence opt4 from neuraminidase__InfluenzaA__CAD29968

SEQ ID NO: 178728 - RNA, 1410 nt, Artificial Sequence; identical to SEQ ID NO: 167093
  derived and/or modified sequence opt4 from neuraminidase__InfluenzaA__CAD29969

SEQ ID NO: 178729 - RNA, 1410 nt, Artificial Sequence
  derived and/or modified sequence opt4 from neuraminidase__InfluenzaA__CAD29970
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauaccccggcaucagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 178730 - RNA, 1410 nt, Artificial Sequence; identical to SEQ ID NO: 169075
  derived and/or modified sequence opt4 from neuraminidase__InfluenzaA__CAD29971

SEQ ID NO: 178731 - RNA, 1410 nt, Artificial Sequence
  derived and/or modified sequence opt4 from neuraminidase__InfluenzaA__CAD29972
augaaccccaaccagaagaucaucaccaucggcagcgugagccugaccaucgccaccaucugcuuccugaugcagaucgugauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacaagaacgccaccgccagcuucaucuacaacggcagacugguggacagcaucggcagcuggagcaagaagauccugagaacccaggagagcgagugcgugugcaucaacggcaccugcgccguggugaugaccgacggcagcgccagcggcaaggccgacaccaagauccuguucaucgaggagggcaagaucggccacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaaccaggagaccgagauccuguggaccagcaacagcaucgugguguucugcggcaccagcggcaccuacggcaccggcagcuggcccgacggcgccgacaucaaccugaugcccaucuga

SEQ ID NO: 178732 - RNA, 1410 nt, Artificial Sequence
  derived and/or modified sequence opt4 from neuraminidase__InfluenzaA__CAD29973
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaagaucaccggcuucgcccccuucagcaaggacaacagcaucagacugagcgccggcggcgacaucugggugaccagagagcccuacgugagcugcgaccccggcaagugcuaccaguucgcccugggccagggcaccacccugaacaacagacacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggccacgacgagaacgccaccgccagcuucaucuacgacggcagacugguggacagcaucggcagcuggagcaagaagauccugagaacccaggagagcgagugcgugugcaucaacggcaccugcaccguggugaugaccgacggcagcgccagcggcagagccgacaccaagauccuguucaucgaggagggcaagaucgugcacaucagcccccugagcggcagcgcccagcacguggaggagugcagcugcuaccccagauacagcggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccugaaccccaacaacgaggagggcggccacggcgugaagggcugggccuucgacgacggcaacgacguguggaugggcagaaccaucagcgagaagcugagaagcggcuacgagaccuucaaggugaucggcggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugugguggaccagcaacagcaucgugguguucugcggcaccagcggcaccuacggcaccggcagcuggcccgacggcgccgacaucaaccugaugcccaucuga

SEQ ID NO: 178733 - RNA, 1410 nt, Artificial Sequence; identical to SEQ ID NO: 175104
  derived and/or modified sequence opt4 from neuraminidase__InfluenzaA__CAD29974

SEQ ID NO: 178734 - RNA, 1410 nt, Artificial Sequence
  derived and/or modified sequence opt4 from neuraminidase__InfluenzaA__CAD29984
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcacuacgugagcugcgacagagacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccaccacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucaaggagggcaagaucgugcacaccagcagccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaaggccaacagcaagcugcagaucaacagacaggugaucguggacagaggcaacagaagcggcuacagcggcaucuucagcguggagagcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178735 - RNA, 1410 nt, Artificial Sequence
  derived and/or modified sequence opt4 from neuraminidase__InfluenzaA__CAD29985
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcagaaccuacggcaccggcagcuggcccgacggcgccgacaucaaccugaugcccaucuga

SEQ ID NO: 178736 - RNA, 1410 nt, Artificial Sequence
  derived and/or modified sequence opt4 from neuraminidase__InfluenzaA__CAD29988
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcgagaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggagagaggcaacagaagcggcuacagcggcaucuucagcguggagggcaagagcugcaucaacagaugcuucuacguggagcugaucagaggcagaaaggaggagaccgaggugugguggaccagcaacagcaucgugguguucugcggcaccagcggcaccuacggcaccggcagcuggcccgacggcgccgacaucaaccugaugcccaucuga

SEQ ID NO: 178737 - RNA, 1410 nt, Artificial Sequence
  derived and/or modified sequence opt4 from neuraminidase__InfluenzaA__CAD29990
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacggcagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacaacagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178738 - RNA, 1410 nt, Artificial Sequence; identical to SEQ ID NO: 166581
  derived and/or modified sequence opt4 from neuraminidase__InfluenzaA__CAD29991

SEQ ID NO: 178739 - RNA, 1410 nt, Artificial Sequence
  derived and/or modified sequence opt4 from neuraminidase__InfluenzaA__CAD29992
augaaccccaaccagaagaucaucaccaucggcagcgugagccugaccaucgccaccaucugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagccugcugagcggcagcgcccagcacguggaggagugcagcugcuaccccagauaccccggcgugagaugcgugugcagagacaacuggaagggcagcaacagacccaucguggacaucaacgugaaggacagaagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178740 - RNA, 1410 nt, Artificial Sequence
  derived and/or modified sequence opt4 from neuraminidase__InfluenzaA__CAD29993
augaaccccaaccagaagaucaucaccaucggcagcgugagccugaccaucgccaccaccugcuuccugaugcagaucgccauccuggugaccaccgugacccugcacuucaagcaguacgagugcaacagcccccccaacaaccaggugaugcugugcgagcccaccaucaucgagagaaacaucaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcgugaccggcgacgacgagaacgccaccgccagcuucaucuacaacggcagacugguggacagcaucggcagcuggagcaagaagauccugagaacccaggagagcgagugcgugugcaucaacggcaccugcaccguggugaugaccgacggcagcgccagcggcaaggccgacaccaagauccuguucaucgaggagggcaagaucgugcacaccagcccccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucagcgagaagcugagaagcggcuacgagaccuucaaggugaucgagggcuggagcaagcccaacagcaagcugcagaucaacagacaggugaucguggacagaggcaacagaagcggcuacagcggcaucuucagcguggagggcaagagcugcaucaacagaugcuucuacguggagcugaucagaggcagaaagcaggagaccgaggugcuguggaccagcaacagcaucgugguguucugcggcaccagcggcaccuacggcaccggcagcuggcccgacggcgccgacaucaaccugaugcccaucuga

SEQ ID NO: 178741 - RNA, 1410 nt, Artificial Sequence; identical to SEQ ID NO: 168269
  derived and/or modified sequence opt4 from neuraminidase__InfluenzaA__CAD29994

SEQ ID NO: 178742 - RNA, 1413 nt, Artificial Sequence; identical to SEQ ID NO: 168973
  derived and/or modified sequence opt4 from neuraminidase__InfluenzaA__CAD57252

SEQ ID NO: 178743 - RNA, 1413 nt, Artificial Sequence
  derived and/or modified sequence opt4 from neuraminidase__InfluenzaA__CAD57253
augaaccccaaccagaagaucaucaccaucggcagcaucagaaucgccaucggcaucaucagccugaugcugcagaucggcaacaucaucagcaucugggccagccacagcauccagaccggcagccagaaccacaccggcgugugcaaccagagaaucaucaccuacgagaacagcaccugggugaaccacaccuacgugaacaucaacaacaccaacgugaucgccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacaagaucuucaagaucgagaagggcaagaucaccaagagcaucgagcugaacgcccccaacuuccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggccugcccaaggagaacaccaccaucuggaccagcggcagcagcaucagcuucugcggcgugaacagcgacaccgccaacuggagcuggcccgacggcgccgagcugcccuucaccaucgacaaguga

SEQ ID NO: 178744 - RNA, 1413 nt, Artificial Sequence; identical to SEQ ID NO: 166916
  derived and/or modified sequence opt4 from neuraminidase__InfluenzaA__CAD57255

SEQ ID NO: 178745 - RNA, 1413 nt, Artificial Sequence
  derived and/or modified sequence opt4 from neuraminidase__InfluenzaA__CAD57256
augaaccccaaccagaagaucaucaccaucggcagcaucagcguggccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacaaguacggcaacggcguguggaucggcagaaccaagagcaacagacugagaaagggcuucgagaugaucugggaccccaacggcuggaccgacaccgacagcgacuucagcgugaagcaggacgugguggccaucaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178746 - RNA, 1413 nt, Artificial Sequence
  derived and/or modified sequence opt4 from neuraminidase__InfluenzaA__CAD57257
augaaccccaaccagaagaucaucaccaucggcagcaucagcaucgccaucggcaucaucagccugaugcugcagaucggcaacaucaucagcaucugggccagccacagcauccagaccggcagccagaaccacaccggcaucugcaaccagagaaucaucaccuacgagaacagcaccugggugaaccacaccuacgugaacaucaacaacaccaacgugguggccggcaaggacaagaccagcgugacccuggccggcaacagcagccugugcagcaucagcggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcaaguucgagagcguggccuggagcgccagcgccugccacgacggcaugggcuggcugaccaucggcaucagcggccccgacaacggcgccguggccgugcugaaguacaacggcaucaucaccgagaccaucaagagcuggaagaagagaauccugagaacccaggagagcgagugcgugugcgugaacggcagcugcuucaccaucaugaccgacggccccagcaacggcgccgccagcuacaagaucuucaagaucgagaagggcaaggugaccaagagcaucgagcugaacgcccccaacagccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaucagacccugcuucuggguggagcuggugagaggcagacccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178747 - RNA, 1413 nt, Artificial Sequence
  derived and/or modified sequence opt4 from neuraminidase__InfluenzaA__CAD57258
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagagaaucaucaccuacgagaacagcaccugggugaaccagaccuacgugaacaucaacaacaccaacgugguggccggcaaggacaagaccagcauggugcuggccggcaacagcagccugugccccaucagaggcugggccaucuacaccaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacagagccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 178748 - RNA, 1413 nt, Artificial Sequence
  derived and/or modified sequence opt4 from neuraminidase__InfluenzaA__CAD57259
augaaccccaaccagaagaucaucaccaucggcagcaucagcaucgccaucggcaucaucagccugauccugcagaucggcaacaucaucagcaucugggccagccacagcauccagaccgagagccagaaccacaccggcaucugcaaccagagaaucaucaccuacgagaacagcaccugggugaaccagaccuacgugaacaucaacaacaccaacguggccgccggcaaggacaagaccagcaugacccuggccggcaacagcagccugugccccaucagaggcugggccaucuacaccaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagagaauccugagaacccaggagagcgagugcgugugcaugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgagaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccgacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacaucguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgacaccgccaacuggagcuggcccgacggcgccgagcugcccuucaccaucgacaaguga

SEQ ID NO: 178749 - RNA, 1413 nt, Artificial Sequence
  derived and/or modified sequence opt4 from neuraminidase__InfluenzaA__CAD57264
augaaccccaaccagaagaucaucaccaucggcagcaucagcguggccaucggcaucaucagccugauccugcagaucggcaacaucaucagcaucugggccagccacagcauccagaccggcagccagaacuacaccggcaucugcaaccagagaaucaucaccuacgagaacagcaccugggugaaccagaccuacgugaacaucaacaacaccaacgugguggccggcaaggacaagaccagcaugacccuggccggcaacagcagccugugccccaucagaggcugggccaucuacaccaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagagcccugaugagcugcccccugggcgaggcccccagccccuacaacagcagauucgagagcguggccuggagcgccagcgccugccacgacggccugggcuggcugaccaucggcaucagcggccccgacaacggcgccguggccgugcugaaguacaacggcaucaucaccgagaccaucaagagcuggaagaagcagauccugagaacccaggagagcgagugcgugugcgugaacggcagcugcuucaccaucaugaccgacggccccagcaacggcgccgccagcuacagaaucuucaagaucgagaagggcagagugaccaagagcaucgagcuggacgcccccaacuaccacuacgaggagugcagcugcuaccccgacaccggcaccgugaugugcgugugcagagacaacuggcacggcagcaacagacccugggugagcuucaaccagaaccuggacuaccagaucggcuacaucugcagcggcguguucggcgacaaccccagacccaaggacggcgagggcagcugcaaccccgugaccguggacggcgccaacggcgugaagggcuucagcuacagauacggcaacggcguguggaucggcagaaccaagagcaacagacugagaaagggcuucgagaugaucugggaccccaacggcuggaccgacaccgacagcgacuucagcaugaagcaggacgugguggccaugaccgacuggagcggcuacagcggcagcuucgugcagcaccccgagcugaccggccuggacugcaugagacccugcuucuggguggagcuggugagaggccugcccagagagaacaccaccaucuggaccagcggcagcagcaucagcuucugcggcgugaacagcgagaccgccaacuggagcuggcccgacggcgccgagcugcccuucaccaucgacaaguga

SEQ ID NO: 178750 - RNA, 1350 nt, Artificial Sequence
  derived and/or modified sequence opt4 from neuraminidase__InfluenzaA__CBW54819
augaaccccaaccagaagaucaucaccaucggcagcaucugcauggugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguacagaaucggcuacaucugcagcggcguguucggcgacaaccccagacccaacgacggcaccggcagcugcggccccgugagccccaacggcgccuacggcgugaagggcuucagcuucaaguacggcgacggcguguggaucggcagaaccaagagcaccaacagcagaagcggcuucgagauggugugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178751 - RNA, 1350 nt, Artificial Sequence
  derived and/or modified sequence opt4 from neuraminidase__InfluenzaA__CBW54821
augaaccccaaccagaagaucaucaccaucggcagcaucugcaucgugaucggcaucgugagccugaugcugcagaucggcaacaugaucagcaucugggugagccacagcauccagaccggcaaccagugccaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcaucaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggccagcccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178752 - RNA, 1410 nt, Artificial Sequence
  derived and/or modified sequence opt4 from neuraminidase__InfluenzaA__CCG47912
augaaccccaaccagaagaucaucaccaucggcagcgugagccugaccaucgccaccaugugccuguucaugcagaucgccauccugaucaccaccgugacccugcacuucaagcaguacgagugcgacagccccgccaacaaccaggugaugcccugcgagcccaucaucaucgagaagaacaucaccaagaucguguaccugaccaacaccaccaucgagaaggaggugugccccaagcugggcgaguacagaaacuggagcaagccccagugcagaaucaccggcuucgcccccuucagcaaggacaacagcaucagacugagcgccggcggcgccaucugggugaccagagagcccuacgugagcugcgaccccaacaagugcuaccaguucgcccugggccagggcaccacccuggacaacagacacagcaacgacaccauccacgacagaacccccuacagaacccugcugaugaacgagcugggcgugcccuuccaccugggcaccagacaggugugcaucgccuggagcagcagcagcugccacgacggcaaggccuggcugcacgugugcgugaccggccacgacaagaacgccaccgccagcuucaucuacgacggcaagcugguggacagcaucagcagcuggagccagaacauccugagaacccaggagagcgagugcgugugcaucaacggcaucugcaccguggugaugaccgacggcagcgccagcggcaaggccgacaccaagauccuguucaucgaggagggcaaggugauccacaucagcccccugcugggcagcgcccagcacguggaggagugcagcugcuaccccagauaccccgacgugagaugcaucugcagagacaacuggaagggcagcaacagacccaucguggacaucagaaugaaggacuacagcaucggcagcagcuacaugugcagcggccuggugggcgacacccccagaaacaacgacggcagcagcaacagcaacugcagaaaccccaacaacgagagaggcaaccacggcgugaagggcugggccuucgacgacggcaacgacaucuggaugggcagaaccaucagcaaggacagcagacugggcuacgagaccuucaagguggugggcggcuggagccagcccaacagcaaguuccagaucaacagacaggugaucguggacagcgacaacagaagcggcuacagcggcaucuucagcguggagggcaagagcugcaucaacagaugcuucuacguggagcugaucagaggcagaagacaggagaccagagugugguggaccagcaacagcaucgugguguucugcggcaccagcggcaccuacggcagcggcagcuggcccgacggcgccgacaucaacuucaugcccaucuga

SEQ ID NO: 178753 - RNA, 1353 nt, Artificial Sequence
  derived and/or modified sequence opt4 from neuraminidase_subtype_1__InfluenzaA__AAF74321
augaaccccaaccagaagaucaucaccaucggcagcaucugcaugguggugggcaucaucagccugaugcugcagaucggcaacaucaucagcgugugggugagccacaccauccagaccuggcaccccaaccagcccgagcccugcaaccagagcaucaacuucuacaccgagcaggccgccgccagcgugacccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacgagcaggccagcuacaagaucuucaagaucgagaagggcagaguggugaagagcguggagcugaacgcccccaacuaccacuaccaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacagccccagacccaacgacggcaccggcagcugcggccccgugagccugaacggcgccuacggcgugaagggcuucagcuucaaguacggcaacggcguguggaucggcagaaccaagagcaccagcagcagaagcggcuucgagaugaucugggaccccaacggcuggaccgagaccgacagcagcuucagccugaagcaggacaucaucgccaucaccgacuggagcggcuacagcggcagcuucauccagcaccccgagcugaccggccugaacugcaugagacccugcuucuggguggagcugaucagaggcagacccaaggagaagaccaucuggaccagcggcagcagcaucagcuucugcggcgugaacagcgacaccgugggcuggagcuggcccgacggcgccgagcugcccuucaccaucgacaaguga

SEQ ID NO: 178754 - RNA, 1353 nt, Artificial Sequence
  derived and/or modified sequence opt4 from neuraminidase_subtype_1__InfluenzaA__AAF74322
augaaccccaaccagaagaucaucaccaucggcagcaucugcaugguggugggcaucaucagccugaugcugcagaucggcaacaccaucagcgugugggugagccacaucaucaagaccuggcaccccaaccagcccgagcccugcaaccagagcaucaacuucuacaccgagcaggccgccgccagcgugacccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacacccugagaacccaggagagcgagugcgccugcgugaacggcagcugcuucaccgugaugaccgacggccccagcaacgagcaggccagcuacaagaucuucaagaucgagaagggcagaguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacagccccagacccaacgacggcaccggcagcugcggccccgugagccugaacggcgccuacggcgugaagggcuucagcuucaaguacggcaacggcguguggaucggcagaaccaagagcaccagcagcagaagcggcuucgagaugaucugggaccccaacggcuggaccgagaccgacagcagcuucagccugaagcaggacaucaucgccaucaccgacuggagcggcuacagcggcagcuucauccagcaccccgagcugaccggccugaacugcaugagacccugcuucuggguggagcugaucagaggcagacccaaggagaagaccaucuggaccagcggcagcagcaucagcuucugcggcgugaacagcgacaccgugggcuggagcuggcccgacggcgccgagcugcccuucaccaucgacaaguga

SEQ ID NO: 178755 - RNA, 1353 nt, Artificial Sequence
  derived and/or modified sequence opt4 from neuraminidase_subtype_1__InfluenzaA__AAF74323
augaaccccaaccagaagaucaucaccaucggcagcaucugcaugguggugggcaucaucagccugaugcugcagaucggcaacaucaucagcguguggaucagccacaucauccagaccuggcaccccaaccagcccgagcccugcaaccagagcaucaacuucuacaccgagcaggccgccgccagcgugacccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaucagcuggcugaccaucggcaucagcggccccgacaacgaggccguggccgugcugaaguacaacggcaucaucaccgacaccaucagaagcuggagaaacaacauccugagaacccaggagagcgagugcgccugcgugaacggcagcugcuucaccgugaugaccgacggccccagcaacgagcaggccagcuacaagaucuucaagaucgagaagggcagaguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacagccccagacccaacgacggcaccggcagcugcggccccgugagccugaacggcgccuacggcgugaagggcuucagcuucaaguacggcaacggcguguggaucggcagaaccaagagcaccagcagcagaagcggcuucgagaugaucugggaccccaacggcuggaccgagaccgacagcagcuucagccugaagcaggacaucaucgccgugaccgacuggagcggcuacagcggcagcuucauccagcaccccgagcugaccggccugaacugcaugagacccugcuucuggguggagcugaucagaggcagacccaaggagaagaccaucuggaccagcggcagcagcaucagcuucugcggcgugaacagcgacaccgugggcuggagcuggcccgacggcgccgagcugcccuucaccaucgacaaguga

SEQ ID NO: 178756 - RNA, 1353 nt, Artificial Sequence
  derived and/or modified sequence opt4 from neuraminidase_subtype_1__InfluenzaA__AAF74324
augaaccccaaccagaagaucaucaccaucggcagcaucugcaugguggugggcaucaucagccugaugcugcagaucggcaacaucaucagcgugugggugagccacaucauccagaccuggcaccccaaccagcccgagcccugcaaccagagcaucaacuucuacaccgagcaggccgccgccagcgugacccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacgagcaggccagcuacaagaucuucaagaucgagaagggcagaguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacagccccagacccaacgacggcaccggcagcugcggccccgugagccugaacggcgccuacggcgugaagggcuucagcuucaaguacggcaacggcguguggaucggcagaaccaagagcaccagcagcagaagcggcuucgagaugaucugggaccccaacggcuggaccgagaccgacagcagcuucagccugaagcaggacaucaucgccaucaccgacuggagcggcuacagcggcagcuucauccagcaccccgagcugaccggccugaacugcaugagacccugcuucuggguggagcugaucagaggcagacccaaggagaagaccaucuggaccagcggcagcagcgugagcuucugcggcgugaacagcgacaccaugggcuggagcuggcccgacggcgccgagcugcccuucaccaucgacaaguga

SEQ ID NO: 178757 - RNA, 1353 nt, Artificial Sequence
  derived and/or modified sequence opt4 from neuraminidase_subtype_1__InfluenzaA__AAF74325
augaaccccaaccagaagaucaucaccaucggcagcaucugcaugguggugggcaucaucagccugaugcugcagaucggcaacaccaucagcgugugggugagccacaucaucaagaccuggcaccccaaccagcccgagcccugcaaccagagcaucaacuucuacaccgagcaggccgccgccagcgugacccuggccggcaacagcagccugugccccaucagcggcugggccaucuacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacacccugagaacccaggagagcgagugcgccugcgugaacggcagcugcuucaccgugaugaccgacggccccagcaacgagcaggccagcuacaagaucuucaagaucgagaagggcagaguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacagccccagacccaacgacggcaccggcagcugcggccccgugagccugaacggcgccuacggcgugaagggcuucagcuucaaguacggcaacggcguguggaucggcagaaccaagagcaccagcagcagaagcggcuucgagaugaucugggaccccaacggcuggaccgagaccgacagcagcuucagccugaagcaggacaucaucgccaucaccgacuggagcggcuacagcggcagcuucauccagcaccccgagcugaccggccugaacugcaugagacccugcuucuggguggagcugaucagaggcagacccaaggagaagaccaucuggaccagcggcagcagcaucagcuucugcggcgugaacagcgacaccgugggcuggagcuggcccgacggcgccgagcugcccuacaccaucgacaaguga

SEQ ID NO: 178758 - RNA, 1410 nt, Artificial Sequence; identical to SEQ ID NO: 169248
  derived and/or modified sequence opt4 from neuraminidase__InfluenzaA__EPI239900

SEQ ID NO: 178759 - RNA, 1410 nt, Artificial Sequence; identical to SEQ ID NO: 169597
  derived and/or modified sequence opt4 from neuraminidase__InfluenzaA__EPI221062

SEQ ID NO: 178760 - RNA, 1410 nt, Artificial Sequence; identical to SEQ ID NO: 169248
  derived and/or modified sequence opt4 from neuraminidase__InfluenzaA__EPI534079

SEQ ID NO: 178761 - RNA, 1410 nt, Artificial Sequence; identical to SEQ ID NO: 169248
  derived and/or modified sequence opt4 from neuraminidase__InfluenzaA__AGM53851

SEQ ID NO: 178762 - RNA, 1410 nt, Artificial Sequence
  derived and/or modified sequence opt4 from neuraminidase__InfluenzaA__EPI731464
augaaccccaaccagaagaucaucaccaucggcagcgugugcaugaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcggcagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178763 - RNA, 1410 nt, Artificial Sequence; identical to SEQ ID NO: 169248
  derived and/or modified sequence opt4 from neuraminidase__InfluenzaA__EPI696973

SEQ ID NO: 178764 - RNA, 1410 nt, Artificial Sequence
  derived and/or modified sequence opt4 from neuraminidase__InfluenzaA__EPI662593
augaaccccaaccagaagaucaucaccaucggcagcaucugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178765 - RNA, 1410 nt, Artificial Sequence; identical to SEQ ID NO: 178764
  derived and/or modified sequence opt4 from neuraminidase__InfluenzaA__EPI830229

SEQ ID NO: 178766 - RNA, 1410 nt, Artificial Sequence; identical to SEQ ID NO: 176357
  derived and/or modified sequence opt4 from neuraminidase__InfluenzaA__AGU92879

SEQ ID NO: 178767 - RNA, 1410 nt, Artificial Sequence; identical to SEQ ID NO: 176356
  derived and/or modified sequence opt4 from neuraminidase__InfluenzaA__AGU92857

SEQ ID NO: 178768 - RNA, 1410 nt, Artificial Sequence; identical to SEQ ID NO: 176355
  derived and/or modified sequence opt4 from neuraminidase__InfluenzaA__AGU92846

SEQ ID NO: 178769 - RNA, 1410 nt, Artificial Sequence; identical to SEQ ID NO: 176366
  derived and/or modified sequence opt4 from neuraminidase__InfluenzaA__AGU92835

SEQ ID NO: 178770 - RNA, 1410 nt, Artificial Sequence; identical to SEQ ID NO: 176342
  derived and/or modified sequence opt4 from neuraminidase__InfluenzaA__AGU92703

SEQ ID NO: 178771 - RNA, 1410 nt, Artificial Sequence
  derived and/or modified sequence opt4 from neuraminidase__InfluenzaA__EPI643117
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcaucugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaccaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178772 - RNA, 1410 nt, Artificial Sequence
  derived and/or modified sequence opt4 from neuraminidase__InfluenzaA__EPI675797
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaaggugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcaucugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaccaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178773 - RNA, 1410 nt, Artificial Sequence; identical to SEQ ID NO: 178771
  derived and/or modified sequence opt4 from neuraminidase__InfluenzaA__EPI578429

SEQ ID NO: 178774 - RNA, 1410 nt, Artificial Sequence; identical to SEQ ID NO: 178771
  derived and/or modified sequence opt4 from neuraminidase__InfluenzaA__EPI614405

SEQ ID NO: 178775 - RNA, 1350 nt, Artificial Sequence; identical to SEQ ID NO: 178693
  derived and/or modified sequence opt4 from neuraminidase__InfluenzaA__AAT73329

SEQ ID NO: 178776 - RNA, 1350 nt, Artificial Sequence; identical to SEQ ID NO: 178693
  derived and/or modified sequence opt4 from neuraminidase__InfluenzaA__AAW80723

SEQ ID NO: 178777 - RNA, 1350 nt, Artificial Sequence; identical to SEQ ID NO: 178693
  derived and/or modified sequence opt4 from neuraminidase__InfluenzaA__EF541467

SEQ ID NO: 178778 - RNA, 1398 nt, Artificial Sequence; identical to SEQ ID NO: 175974
  derived and/or modified sequence opt4 from neuraminidase__InfluenzaA__EPI439509

SEQ ID NO: 178779 - RNA, 1410 nt, Artificial Sequence
  derived and/or modified sequence opt4 from neuraminidase__InfluenzaA__EPI482776
augaacaccaaccagagaaucaucaccaucggcaccgugugcaugaucgugggcaucaucagccugcugcugcagaucggcaacaucgugagccuguggaucagccacagcauccagaccggcugggagaaccacaccgugaugugcaaccagagcgugaucaccuacgugaacaacaccugggugaacagaaccuacgugaacaucagcaacaucaagaucgccaccauccaggacgugaccagcaucauccuggccggcaacagcagccugugccccgugagcggcugggccguguacagcaaggacaacagcaucagaaucggcagcaagggcgacaucuucgugaucagagagcccuucaucagcugcagccagcuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagguggagaagggcaagaucaucaagagcaucgagcuggacgcccccaacuaccacuacgaggagugcagcugcuaccccgacaccggcaaggugaugugcgugugcagagacaacuggcacgccagcaacagacccugggugagcuucaaccagaaccuggacuaccagaucggcuacaucugcagcggcguguucggcgacaaccccagaagcaacgacggcaagggcaacugcggccccgugcugagcaacggcgccaacggcgugaagggcuucagcuacagauacggcaacggcguguggaucggcagaaccaagagcaucaacagcagaagcggcuucgagaugaucugggaccccaacggcuggaccgagaccgacagcagcuucagcaugaagcaggacaucaucgcccugaacgacuggagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcgugaacagcgagaccgccagcuggagcuggcccgacggcgccgaccugcccuucaccaucgacaaguga

SEQ ID NO: 178780 - RNA, 1410 nt, Artificial Sequence
  derived and/or modified sequence opt4 from neuraminidase__InfluenzaA__EPI745533
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucaagcccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178781 - RNA, 1410 nt, Artificial Sequence; identical to SEQ ID NO: 169248
  derived and/or modified sequence opt4 from neuraminidase__InfluenzaA__AEE69012

SEQ ID NO: 178782 - RNA, 1410 nt, Artificial Sequence; identical to SEQ ID NO: 169248
  derived and/or modified sequence opt4 from neuraminidase__InfluenzaA__EPI176609

SEQ ID NO: 178783 - RNA, 1410 nt, Artificial Sequence; identical to SEQ ID NO: 169248
  derived and/or modified sequence opt4 from neuraminidase__InfluenzaA__EPI176472

SEQ ID NO: 178784 - RNA, 1410 nt, Artificial Sequence
  derived and/or modified sequence opt4 from neuraminidase__InfluenzaA__EPI280340
augaaccccaaccagaagaucaucaccaucggcagcgugugcaucaccaucggcauggccaaccugauccugcagaucggcaacaucaucagcaucuggaucagccacagcauccagcugggcaaccagaaccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcaucagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcaucuucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaacggcuucgagaucaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccaaggagaacaccaucuggaccagcggcagcagcaucagcuucugcggcgugaacagcgacaccgugggcuggagcuggcccgacggcgccgagcugcccuucaccaucgacaaguga

SEQ ID NO: 178785 - RNA, 1410 nt, Artificial Sequence; identical to SEQ ID NO: 169248
  derived and/or modified sequence opt4 from neuraminidase__InfluenzaA__EPI240318

SEQ ID NO: 178786 - RNA, 1410 nt, Artificial Sequence; identical to SEQ ID NO: 169248
  derived and/or modified sequence opt4 from neuraminidase__InfluenzaA__EPI183133

SEQ ID NO: 178787 - RNA, 1410 nt, Artificial Sequence; identical to SEQ ID NO: 169248
  derived and/or modified sequence opt4 from neuraminidase__InfluenzaA__EPI369141

SEQ ID NO: 178788 - RNA, 1410 nt, Artificial Sequence
  derived and/or modified sequence opt4 from neuraminidase__InfluenzaA__EPI482787
augaacaccaaccagagaaucaucaccaucggcaccgugugccugaucgugggcaucgugagccugcugcugcagaucggcaacaucgugagccuguggaucagccacagcauccagaccggcaagagaagccaccccgagaccugcagccagaacgugaucaccuacgagaacaacaccugggugaaccagaccuacgugaacaucagcaacaccaacaucguggacggccagggcgugaccagcaucauccuggccggcaacagcccccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagugcagcugcuaccccgacaccggcaagguggugugcgugugcagagacaacuggcacgccagcaacagacccugggugaccuucgaccagaaccugaacuaccagaucggcuacaucugcagcggcguguucggcgacaaccccagaagcaacgacggcaagggcaacugcggccccgugcccagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaucaagcaggacaucaucgcccugaccgacuggagcggcuacagcggcagcuucgugcagcaccccgagcugaccggcaugaacugcaucaagcccugcuucuggguggagcugaucagaggccagcccaaggagagcaccaucuggaccagcggcagcagcaucagcuucugcggcguggacagcgagaccgugagcuggagcuggcccgacggcgccgaccugcccuucaccaucgacaaguga

SEQ ID NO: 178789 - RNA, 1410 nt, Artificial Sequence
  derived and/or modified sequence opt4 from neuraminidase__InfluenzaA__EPI482790
augaacaccaaccagagaaucaucaccaucggcaccgugugccugaucgugggcaucaucagccugcugcugcagaucggcaacauggugagccuguggaucagccacagcauccagaccggcggcaagaaccacaccgagaugugcaaccagaacgugaucaccuacgugaacaacaccugggugaacagaaccuacgugaacaucagcaacaccaagaucgugaacgugcaggacguggugagcgugauccugaccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagaacccugaugagcugccccgugggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagauggagaagggcaagaucaucaagagcaucgagcuggacgcccccaacuaccacuacgaggagugcagcugcuaccccgacgccggcaaggugaugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcacagcaacggcgccaacggcgugaagggcuucagcuacagauacggcaacggcguguggaucggcagaaccaagagcaucaacagcagaagcggcuucgagaugaucugggaccccaacggcuggaccggcaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagaacaccaucugggccagcggcagcagcaucagcuucugcggcgugaacggcgagaccgccagcuggagcuggcccgacggcgccgaccugcccuucaccaucgacaaguga

SEQ ID NO: 178790 - RNA, 1410 nt, Artificial Sequence
  derived and/or modified sequence opt4 from neuraminidase__InfluenzaA__EPI291797
augaacaccaaccagagaaucaucaccaucggcaccgugugcaugaucgugggcaucaucagccugcugcugcagaucggcaacaucgugagccuguggaucagccacagcauccagaccggcugggagaaccacaccgagaugugcaaccagagcgugaucaccuacgugaacaacaccugggugaacagaaccuacgugaacaucagcaacaccaacaucgccaccauccaggacgugaccagcaucauccuggccggcaacagcagccugugccccgugagcggcugggccaucuacagcaaggacaacagcaucagaaucggcagcaagggcgacaucuucgugaucagagagcccuucaucagcugcagccagcuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagguggagaagggcaagaucaucaagagcaucgagcuggacgcccccaacuaccacuacgaggagugcagcugcuaccccgacaccggcaaggugaugugcgugugcagagacaacuggcacgccagcaacagacccugggugagcuucaaccagaaccuggacuaccagaucggcuacaucugcagcggcguguucggcgacaaccccagaagcaacgacggcaagggcaacugcggccccgugcugagcaacggcgccaacggcgugaagggcuucagcuacagauacggcaacggcguguggaucggcagaaccaagagcaucaacagcagaagcggcuucgagaugaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcgugaacagcgagaccgccagcuggagcuggcccgacggcgccgaccugcccuucaccaucgacaaguga

SEQ ID NO: 178791 - RNA, 1410 nt, Artificial Sequence; identical to SEQ ID NO: 178790
  derived and/or modified sequence opt4 from neuraminidase__InfluenzaA__EPI482798

SEQ ID NO: 178792 - RNA, 1410 nt, Artificial Sequence
  derived and/or modified sequence opt4 from neuraminidase__InfluenzaA__EPI638969
augaacaccaaccagagaaucaucaccaucggcaccgugugcaugaucgugggcaugaucagccugcugcugcagaucggcagcaucgugagccuguggaucagccacagcauccagaccggcugggagaaccacaccggcgugugcaaccagagcgugaucaccuacgugaacaacaccugggugaacagaaccuacgugaacaucagcaacaucaagaucgccaccauccaggacgugacccccaucauccuggccggcaacagcagccugugccccgugaacggcugggccguguacagcaaggacaacagcaucagaaucggcagcaagggcgacaucuucgugaucagagagcccuucaucagcugcagccagcuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagguggagaagggcaagaucaucaagagcaucgagcuggacgcccccaacuaccacuacgaggagugcagcugcuaccccgacaccggcaaggugaugugcgugugcagagacaacuggcacgccagcaacagacccugggugagcuucaaccagaaccuggacuaccagaucggcuacaucugcagcggcguguucggcgacaaccccagaagcaccgacggcaagggcaacugcggccccgugcugagcaacggcgccaacggcgugaagggcuucagcuacagauacggcaacggcguguggaucggcagaaccaagagcaucaacagcagaagcggcuucgagaugaucugggaccccaacggcuggaccgagaccgacagcagcuucagcaugaagcaggacaucaucgcccugaacgacuacagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcgugaacagcgagaccgccagcuggagcuggcccgacggcgccgaccugcccuucgccaucgacaaguga

SEQ ID NO: 178793 - RNA, 1410 nt, Artificial Sequence
  derived and/or modified sequence opt4 from neuraminidase__InfluenzaA__ABI19012
augaacaccaaccagagaaucaucaccaucggcaccgugugccugaucgugggcaucaucagccugcugcugcagaucggcaacauggugagccuguggaucagccacagcauccagaccggcggcaagaaccacaccgagaugugcaaccagaacgugaucaccuacgugaacaacaccugggugaacagaaccuacgugaacaucagcaacaccaagaucgugaacgugcaggacguggugagcgugauccugaccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagauggagaagggcaagaucaucaagagcaucgagcuggacgcccccaacuaccacuacgaggagugcagcugcuaccccgacgccggcaaggugaugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcacagcaacggcgccaacggcgugaagggcuucagcuacagauacggcaacggcguguggaucggcagaaccaagagcaucaacagcagaagcggcuucgagaugaucugggaccccaacggcuggaccggcaccgacagcagcuucagcaugaagcaggacaucaucgcccugaccgacuggagcggcuacagcggcagcuucgugagacaccccgagcugaccggcaugaacugcaucagacccugcuucuggguggagcugaucagaggccagcccaaggagaacaccaucugggccagcggcagcagcaucagcuucugcggcgugaacggcgagaccgccagcuggagcuggcccgacggcgccgaccugcccuucaccaucgacaaguga

SEQ ID NO: 178794 - RNA, 1410 nt, Artificial Sequence
  derived and/or modified sequence opt4 from neuraminidase__InfluenzaA__EPI687791
augaaccccaaccagaagaucaucaccaucggcagcaucugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccagacagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178795 - RNA, 1410 nt, Artificial Sequence
  derived and/or modified sequence opt4 from neuraminidase__InfluenzaA__EPI841266
augaaccccaaccagaagaucaucaccaucggcagcaucugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccagacagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgaggagggcaagaucaucaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178796 - RNA, 1410 nt, Artificial Sequence
  derived and/or modified sequence opt4 from neuraminidase__InfluenzaA__EPI291844
augaacaccaaccagagaaucaucaccaucggcaccgugugccugaucgugggcaucaucagccugcugcugcagaucggcaccauggugagccuguggaucagccacagcauccagaccggcggcaagaaccacaccgagaugugcaaccagaacgugaucaccuacgugaacaacaccugggugaacagaaccuacgugaacaucagcaacaccaagaucgugaacgugcaggacguggugagcgugauccugaccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagauggagaagggcaagaucaucaagagcaucgagcuggacgcccccaacuaccacuacgaggagugcagcugcuaccccgacgccggcaaggugaugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcacagcaacggcgccaacggcgugaagggcuucagcuacaaguacggcaacggcguguggaucggcagaaccaagagcaucaacagcagaagcggcuucgagaugaucugggaccccaacggcuggaccggcaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagaacaccaucugggccagcggcagcagcaucagcuucugcggcgugaacggcgagaccgccagcuggagcuggcccgacggcgccgaccugcccuucaccaucgacaaguga

SEQ ID NO: 178797 - RNA, 1410 nt, Artificial Sequence
  derived and/or modified sequence opt4 from neuraminidase__InfluenzaA__EPI558120
augaacaccaaccagagaaucaucaccaucggcaccgugugcaugaucgugggcaucaucagccugcugcugcagaucggcaacaucgugagccuguggaucagccacagcauccagaccggcugggagaaccacaccgagaugugcaaccagagcgugaucaccuacgugaacaacaccuggaugaacagaaccuacgugaacaucagcaacaucaagaucgccaccauccaggacgugaccagcaucgugcuggccggcaacagcagccugugccccgugagcggcugggccguguacagcaaggacaacagcaucagaaucggcagcaagggcgacaucuucgugaucagagagcccuucaucagcugcagccagcuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccgugcugaccgacggccccagcaacggccaggccagcuacaagaucuucaagguggagaagggcaagaucaucaagagcaucgagcuggacgcccccaacuaccacuacgaggagugcagcugcuaccccgacaccggcaaggugaugugcaucugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuacagauacggcaacggcguguggaucggcagaaccaagagcaucaacagcagaagcggcuucgagaugaucugggaccccaacggcuggaccgagaccgacagcagcuucagcaugaagcaggacaucaucgcccugaacgacuggagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcgugaacagcgagaccgccagcuggagcuggcccgacggcgccgaccugcccuucaccaucgacaaguga

SEQ ID NO: 178798 - RNA, 1410 nt, Artificial Sequence
  derived and/or modified sequence opt4 from neuraminidase__InfluenzaA__EPI564138
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugguggagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178799 - RNA, 1410 nt, Artificial Sequence
  derived and/or modified sequence opt4 from neuraminidase__InfluenzaA__ANM92825
augaaccccaaccagaagaucaucaccaucggcagcaucugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcguguucggcgacaaccccagacccaacgacaagaccggcaacugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178800 - RNA, 1410 nt, Artificial Sequence
  derived and/or modified sequence opt4 from neuraminidase__InfluenzaA__EPI291694
augaacaccaaccagagaaucaucaccaucggcaccgugugccugaucgugggcaucgugagccugcugcugcagaucggcaacaucgugagccuguggaucagccacagcauccagaccggcgagaagaaccacagcgaggugugcaaccagaacaucaucaccuacgagaacaagaccugggugaaccagaccuacgugaacaucagcaacaccaacaucgccgagggccagggcgugaccagcaucauccuggccggcaacagcagccugugccccgugagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccugaccggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcccagcaacggcgccaacggcgugaagggcuucagcuucagauacggcaacggcguguggaucggcagaaccaagagcaucaucagcagaagcggcuucgagaugaucugggaccccaacggcuggaccgagaccgacagcagcuucagcaucaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcguggacagcgagaccgccagcuggagcuggcccgacggcgccgaccugcccuucaccaucgacaaguga

SEQ ID NO: 178801 - RNA, 1410 nt, Artificial Sequence; identical to SEQ ID NO: 169734
  derived and/or modified sequence opt4 from neuraminidase__InfluenzaA__EPI241027

SEQ ID NO: 178802 - RNA, 1410 nt, Artificial Sequence; identical to SEQ ID NO: 169258
  derived and/or modified sequence opt4 from neuraminidase__InfluenzaA__EPI177405

SEQ ID NO: 178803 - RNA, 1410 nt, Artificial Sequence; identical to SEQ ID NO: 169258
  derived and/or modified sequence opt4 from neuraminidase__InfluenzaA__EPI242475

SEQ ID NO: 178804 - RNA, 1410 nt, Artificial Sequence
  derived and/or modified sequence opt4 from neuraminidase__InfluenzaA__EPI590131
augaacgccaaccagagaaucaucaccaucggcaccgugugccugaucaucggcaucaucagccugcugcugcagaucggcaacauggugagccuguggaucagccacagcauccagaccggcggcaagaaccacaccgagaugugcaaccagaacgugaucaccuacgugaacaacaccugggugaacagaaccuacgugaacaucagcaacaccaagaucgugaacgugcaggacguggugagcgugauccugaccggcaacagcagccugugcagcaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaucggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucgccgugcugaccgacggccccagcaacggccaggccagcuacaagaucuucaaggugaagcagggcaagaucaucaagagcaucgagcuggacgcccccaacuaccacuacgaggagugcagcugcuaccccgacgccggcaaggugaugugcgugugcagagacaacuggcacgccagcaacagacccugggugagcuucgaccaggaccugaacuaccagaucggcuacaucugcagcggcguguucggcgacaaccccagaagcaacgacggcaagggcaacugcggccccgugcacagcaacggcgccaacggcgugaagggcuucagcuacagauacggcaacggcguguggaucggcagaaccaagagcauccacagcagaagcggcuucgagaugaucugggaccccaacggcuggaccggcaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagaacaccaucugggccagcggcagcagcaucagcuucugcggcgugaacggcgagaccgccagcuggagcuggcccgacggcgccgaccugcccuucaccaucgacaaguga

SEQ ID NO: 178805 - RNA, 1410 nt, Artificial Sequence
  derived and/or modified sequence opt4 from neuraminidase__InfluenzaA__EPI68596
augaacaccaaccagagaaucaucaccaucggcaccgugugccugaucgugggcaucgugagccugcugcugcagaucggcaacaucgugagccuguggaucagccacagcauccagaccggcgagaagaaccacagcgagaucugcagccagaacgugaucaccuacgagaacaacaccugggugaaccagaccuacgugaacaucagcaacaccaacaucgccgacggccagggcgugaccagcaucauccuggccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaucaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcguggacagcgagaccgccagcuggagcuggcccgacggcgccgaccugcccuucaccaucgacaaguga

SEQ ID NO: 178806 - RNA, 1365 nt, Artificial Sequence; identical to SEQ ID NO: 168239
  derived and/or modified sequence opt4 from neuraminidase__InfluenzaA__EPI115409

SEQ ID NO: 178807 - RNA, 1365 nt, Artificial Sequence; identical to SEQ ID NO: 168239
  derived and/or modified sequence opt4 from neuraminidase__InfluenzaA__ABD77678/m1

SEQ ID NO: 178808 - RNA, 1410 nt, Artificial Sequence; identical to SEQ ID NO: 169248
  derived and/or modified sequence opt4 from neuraminidase__InfluenzaA__EPI185224

SEQ ID NO: 178809 - RNA, 1410 nt, Artificial Sequence; identical to SEQ ID NO: 178764
  derived and/or modified sequence opt4 from neuraminidase__InfluenzaA__EPI697745

SEQ ID NO: 178810 - RNA, 1410 nt, Artificial Sequence; identical to SEQ ID NO: 178764
  derived and/or modified sequence opt4 from neuraminidase__InfluenzaA__EPI768524

SEQ ID NO: 178811 - RNA, 1410 nt, Artificial Sequence
  derived and/or modified sequence opt4 from neuraminidase__InfluenzaA__EPI726929
augaaccccaaccagaagaucaucaccaucggcagcaucagcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucaucaagagcguggagaugaaggcccccaacuaccacuacgaggagugcagcugcuaccccgacagcagcgagaucaccugcgugugcagagacaacuggcacggcagcaacagacccugggugagcuucaaccagaaccuggaguaccagaugggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaaguucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178812 - RNA, 1410 nt, Artificial Sequence; identical to SEQ ID NO: 178811
  derived and/or modified sequence opt4 from neuraminidase__InfluenzaA__EPI813816

SEQ ID NO: 178813 - RNA, 1410 nt, Artificial Sequence
  derived and/or modified sequence opt4 from neuraminidase__InfluenzaA__EPI466627
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccugacccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178814 - RNA, 1410 nt, Artificial Sequence
  derived and/or modified sequence opt4 from neuraminidase__InfluenzaA__EPI541965
augaaccccaaccagaagaucaucaccaucggcagcgugugcaugaccaucggcauggccaaccugauccugcagaucggcaacaucaucagcaucugggugagccacagcauccagcugggcaaccagagccagaucgagaccugcaaccagagcgugaucaccuacgagaacaacaccugggugaaccagaccuacgugaacaucagcaacaccaacuucgccgccggccagcccguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccuggcccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178815 - RNA, 1410 nt, Artificial Sequence
  derived and/or modified sequence opt4 from neuraminidase__InfluenzaA__EPI652004
augaaccccaaccagaagaucaucaccaucggcagcgugugcaugaccaucggcauggccaaccugauccugcagaucggcaacaucaucagcaucugggugagccacagcauccagaucggcaaccagagccagaucgagaccugcaaccagagcgugaucaccuacgagaacaacaccugggugaaccagaccuacgugaacaucagcaacaccaacuucgccgccggccagagcguggugagcgugaagcuggccggcaacagcagccugugccccgugagcggcugggccaucuacagcaaggacaacagcgugagaaucggcagcaagggcgacguguucgugaucagagagcccuucaucagcugcagcccccuggagugcagaaccuucuuccuggcccagggcgcccugcugaacgacaagcacagcaacggcaccaucaaggacagaagccccuacagaacccugaugagcugccccaucggcgaggugcccagccccuacaacagcagauucgagagcguggccuggagcgccagcgccugccacgacggcaucaacuggcugaccaucggcaucagcggccccgacagcggcgccguggccgugcugaaguacaacggcaucaucaccgacaccaucaagagcuggagaaacaacauccugagaacccaggagagcgagugcgccugcgugaacggcagcugcuucaccaucaugaccgacggccccagcgacggccaggccagcuacaagaucuucagaaucgagaagggcaagaucgugaagagcguggagaugaacgcccccaacuaccacuacgaggagugcagcugcuaccccgacagcagcgagaucaccugcgugugcagagacaacuggcacggcagcaacagacccugggugagcuucaaccagaaccuggaguaccagaucggcuacaucugcagcggcguguucggcgacaaccccagacccaacgacaagaccggcagcugcggccccgugagcagcaacggcgccaacggcgugaagggcuucagcuucaaguacggcaacggcguguggaucggcagaaccaagagcaucagcagcagaaagggcuucgagaugaucugggaccccaacggcuggaccggcaccgacaacaacuucagcaucaagcaggacaucgugggcaucaacgaguggagcggcuacagcggcagcuucgugcagcaccccgagcugaccggccuggacugcaucagacccugcuucuggguggagcugaucagaggcagacccgaggagaacaccaucuggaccagcggcagcagcaucagcuucugcggcgugaacagcgacaccgugggcuggagcuggcccgacggcgccgagcugcccuucaccaucgacaaguga

SEQ ID NO: 178816 - RNA, 1410 nt, Artificial Sequence
  derived and/or modified sequence opt4 from neuraminidase__InfluenzaA__EPI62526
augaacaccaaccagagaaucaucaccaucggcaccgugugccugaucgugggcaucgugagccugcugcugcagaucggcaacaucgugagccuguggaucagccacagcauccagaccggcgagaagaaccaccccgagaucugcagccagaacgugaucaccuacgagaacaacaccugggugaaccagaccuacgugaacaucagcaacaccaacaucguggacggccagggcgugaccagcaucauccuggccggcaacagcagccugugccccaucagcggcugggccaucuacagcaaggacaacagcaucagaaucggcagcaagggcgacaucuucgugaucagagagcccuucaucagcugcagccaccuggagugcagaaccuucuuccugacccagggcgcccugcugaacgacagacacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaucaacggcagcugcuucaccaucaugaccgacggccccagcaacggccaggccagcuacaagaucuucaagauggagaagggcaagaucaucaagagcguggagcuggacgcccccaacuaccacuacgaggagugcagcugcuaccccgacaccggcaagguggugugcgugugcagagacaacuggcacgccagcaacagacccugggugagcuucgaccagaaccuggacuaccagaucggcuacaucugcagcggcguguucggcgacaaccccagaagcaacgacggcaagggcaacugcggccccgugcugagcaacggcgccaacggcgugaagggcuucagcuucagauacggcaacggcguguggaucggcagaaccaagagcaucagcagcagaagcggcuucgagaugaucugggaccccaacggcuggaccgagaccgacagcagcuucagcaucaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucuggaccagcggcagcagcaucagcuucugcggcguggacagcgagaccgccagcuggagcuggcccgacggcgccgaccugcccuucaccaucgacaaguga

SEQ ID NO: 178817 - RNA, 1410 nt, Artificial Sequence; identical to SEQ ID NO: 169248
  derived and/or modified sequence opt4 from neuraminidase__InfluenzaA__EPI189183

SEQ ID NO: 178818 - RNA, 1410 nt, Artificial Sequence; identical to SEQ ID NO: 169248
  derived and/or modified sequence opt4 from neuraminidase__InfluenzaA__EPI180576

SEQ ID NO: 178819 - RNA, 1410 nt, Artificial Sequence
  derived and/or modified sequence opt4 from neuraminidase__InfluenzaA__EPI346918
augaacaccaaccagagaaucaucaccaucggcaccgugugcaugaucgugggcaucaucagccugcugcugcagaucggcaacaucgugagccuguggaucagccacagcauccagaccggcugggagaaccacaccgagaugugcaaccagaacgugaucaccuacgugaacaacaccugggugaacagaaccuacgugaacgugagcaacaccaacaucgccaccauccaggacgugaccagcaucgugcuggccggcaacagcagccugugccccgugagcggcugggccaucuacagcaaggacaacagcaucagaaucggcagcaagggcgacaucuucgugaucagagagcccuucaucagcugcagccagcuggagugcagaaccuucuuccugacccagggcgcccugcugaacgacaagcacagcaacggcaccgugaaggacagaagccccuacagaacccugaugagcugccccaucggcgaggcccccagccccuacaacagcagauucgagagcguggccuggagcgccagcgccugccacgacggcaugggcuggcugaccaucggcaucagcggccccgacaacggcgccguggccgugcugaaguacaacggcaucaucaccgacaccaucaagagcuggagaaacaagauccugagaacccaggagagcgagugcgugugcaugaacggcagcugcuucaccgugcugaccgacggccccagcaacggccaggccagcuacaagaucuucaagguggagaagggcagaaucaucaagagcaucgagcuggacgcccccaacuaccacuacgaggagugcagcugcuaccccgacaccggcaaggugaugugcgugugcagagacaacuggcacgccagcaacagacccugggugagcuucaaccagaaccuggacuaccagaucggcuacaucugcagcggcguguucggcgacaaccccagaagcaacgacggcaagggcaacugcggccccgugcugagcaacggcgccaacggcgugaagggcuucagcuacagauacggcaacggcguguggaucggcagaaccaagagcaucaacagcagaagaggcuucgagaucaucugggaccccaacggcuggaccgagaccgacagcagcuucagcaugaagcaggacaucaucgcccugaccgacuggagcggcuacagcggcagcuucgugcagcaccccgagcugaccggcaugaacugcaucagacccugcuucuggguggagcugaucagaggccagcccaaggagagcaccaucugggccagcggcagcagcaucagcuucugcggcgugaacagcgagaccgccagcuggagcuggcccgacggcgccgaccugcccuucaccaucgacaaguga

SEQ ID NO: 178820 - RNA, 1410 nt, Artificial Sequence; identical to SEQ ID NO: 169836
  derived and/or modified sequence opt4 from neuraminidase__InfluenzaA__EPI240976

SEQ ID NO: 178821 - RNA, 1410 nt, Artificial Sequence; identical to SEQ ID NO: 166615
  derived and/or modified sequence opt4 from neuraminidase__InfluenzaA__EPI3165

SEQ ID NO: 178822 - RNA, 1410 nt, Artificial Sequence; identical to SEQ ID NO: 178541
  derived and/or modified sequence opt4 from neuraminidase__InfluenzaA__EPI957

SEQ ID NO: 178823 - RNA, 1410 nt, Artificial Sequence; identical to SEQ ID NO: 174666
  derived and/or modified sequence opt4 from neuraminidase__InfluenzaA__EPI507593

SEQ ID NO: 178824 - RNA, 1410 nt, Artificial Sequence; identical to SEQ ID NO: 174666
  derived and/or modified sequence opt4 from neuraminidase__InfluenzaA__EPI461954

SEQ ID NO: 178825 - RNA, 1410 nt, Artificial Sequence; identical to SEQ ID NO: 174666
  derived and/or modified sequence opt4 from neuraminidase__InfluenzaA__EPI461954

SEQ ID NO: 178826 - RNA, 1410 nt, Artificial Sequence
  derived and/or modified sequence opt4 from neuraminidase__InfluenzaA__EPI668104
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuucuaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcaacgccagcggcaaggccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugguggagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178827 - RNA, 1410 nt, Artificial Sequence
  derived and/or modified sequence opt4 from neuraminidase__InfluenzaA__EPI578445
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcaacgccagcggcaaggccgacaccaagauccuguucaucgaggagggcaagaucgugcacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugguggagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178828 - RNA, 1410 nt, Artificial Sequence; identical to SEQ ID NO: 178827
  derived and/or modified sequence opt4 from neuraminidase__InfluenzaA__EPI551883

SEQ ID NO: 178829 - RNA, 1410 nt, Artificial Sequence
  derived and/or modified sequence opt4 from neuraminidase__InfluenzaA__EPI344388
augaaccccaaccagaagaucaucaccaucggcagcgugagccugaucaucgccaccaucugcuuccugaugcagaucgccauccuggugaccaccgugacccugcacuucaagcagcacgacuacaacagcccccccaacaaccaggccaugcugugcgagcccaccaucaucgagagaaacaccaccgagaucguguaccugaccaacaccaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugcacgacagaacccccuacagaacccugcugaugaacgagcugggcgugcccuuccaccugggcaccagacaggugugcauggccuggagcagcagcagcugccacgacggcaaggccuggcugcacgugugcaucaccggcaacgacaacaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucguggaggagggcaagaucgugcacaucagcacccugagcggcagcgcccagcacguggaggagugcagcugcuaccccagauuccccggcgugagaugcgugugcagagacaacuggaagggcagcaacagacccaucguggacaucaacgugaagaacuacagcaucgugagcagcuacgugugcagcggccuggugggcgacacccccagaaagagcgacagcgugagcagcagcuacugccuggaccccaacaacgagaagggcggccacggcgugaagggcugggccuucgacgacggcaacgacguguggaugggcagaaccaucaacgagacccugagacugggcuacgagaccuucaaggugaucgagggcuggagcaaggccaacagcaagcugcagaccaacagacaggugaucguggagaagggcgacagaagcggcuacagcggcaucuucagcguggagggcaagagcugcaucaacagaugcuucuacguggagcugaucagaggcagaaaggaggagaccaaggugugguggaccagcaacagcaucgugguguucugcggcaccagcggcaccuacggcaccggcagcuggcccgacggcgccgacaucaaccugaugcccaucuga

SEQ ID NO: 178830 - RNA, 1410 nt, Artificial Sequence; identical to SEQ ID NO: 178829
  derived and/or modified sequence opt4 from neuraminidase__InfluenzaA__EPI347601

SEQ ID NO: 178831 - RNA, 1410 nt, Artificial Sequence
  derived and/or modified sequence opt4 from neuraminidase__InfluenzaA__EPI642512
augaaccccaaccagaagaucaucaccaucggcagcaucagccugaucaucgccaccaucugcuuccugaugcagaucgccauccuggugaucaccgugacccugcacuucaagcagcacaacugcgacagcagccccaacaaccaggugauguucugcgagcccaccaucaucgagagaaacaagaccgagaucguguaccugaucaacaccaccguggagaaggagaucugccccaagcccaccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacgacaccgugcacgacagaacccccuacagaacccugcugaugaacgagcugggcgugcccuuccaccugggcaccagacaggugugcaucgccuggagcagcagcagcugccacgacggcaaggccuggcugcacgugugcaucaccggcgacgacggcaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucauccacaucagcacccugagcggcagcgcccagcacguggaggagugcagcugcuaccccagauaccccggcgugagaugcgugugcagagacaacuggaagggcagcaacagacccaucguggacaucaacgugaaggacuacagcaucgugagcagcuacgugugcagcggccuggugggcgacacccccagaaagaacgacagcuucagcagcagccacugccuggaccccaacaacgaggagggcggccacggcgugaagggcugggccuucgacgacggcaacgacguguggaugggcagaaccaucagcgagaagagcagacugggcuacgagaccuucaagguggugaagggcuggagcgagcccaacagcaagcugcagaccaacagacaggugaucgugggcagaggcaacagaagcggcuacagcggcaucuucagcaucgagggcaagaacugcaucaacagaugcuucuacguggagcugaucagaggcagaaaggaggagaccaaggugugguggaccagcaacagcaucgugguguucugcggcaccagcggcaccuacggcaccggcagcuggcccgacggcgccgacaucaaccugaugcccaucuga

SEQ ID NO: 178832 - RNA, 1410 nt, Artificial Sequence
  derived and/or modified sequence opt4 from neuraminidase__InfluenzaA__AIE52540
augaaccccaaccagaagaucaucaccaucggcagcgugagccugaucaucgccaccaucugcuuccugaugcagaucgccauccuggugaccaccgugacccugcacuucaagcagcacgacuacaacagcccccccaacaaccaggugaugcugugcgagcccaccaucaucgagagaaacaccaccgagaucguguaccugaccaacaucaccaucgagaaggagaucugccccaagcuggccgaguacagaaacuggagcaagccccagugcaacaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacagacacagcaacaacaccgugcacgacagaagccccuacagaacccugcugaugaacgagcugggcgugcccuuccaccugggcaccagacaggugugcaucgccuggagcagcagcagcugccacgacggcaaggccuggcugcacgugugcaucaccggcgacgacaacaacgccaccgccagcuucaucuacaacggcagacugguggacagcaucggcagcuggagcaagaacauccugagaacccaggagagcgagugcgugugcaucaacggcaccugcaccguggugaugaccgacggcagcgccagcggcaaggccgacaccaagauccuguucaucgaggagggcaagaucgugcacaucagcacccugagcggcagcgcccagcacguggaggagugcagcugcuaccccagauaccccggcgugagaugcgugugcagagacaacuggaagggcagcaacagacccaucguggacaucaacaugaaggacuacagcaucgccagcagcuacgugugcagcggccuggugggcgacacccccagaaagaacgacagcuucagcagcagccacugccuggaccccaacaacgagaagggcggccacggcgugaagggcugggccuucgacgacggcaacgacguguggaugggcagaaccaucagcgaggaguucagacugggcuacgagaccuucaaggugaucaagggcuggagcaaccccaacagcaagcugcagaccaacagacaggugaucguggagaagggcaacagaagcggcuacagcggcguguucagcaucgaggacaagagcugcaucaacagaugcuucuacguggagcugaucagaggcagaaaggaggagaccaaggugugguggaccagcaacagcaucgugguguucugcggcaccagcggcaccuacggcaccggcagcuggcccgacggcgccgacaucaaccugaugcccaucuga

SEQ ID NO: 178833 - RNA, 1410 nt, Artificial Sequence; identical to SEQ ID NO: 178832
  derived and/or modified sequence opt4 from neuraminidase__InfluenzaA__EPI465399

SEQ ID NO: 178834 - RNA, 1410 nt, Artificial Sequence; identical to SEQ ID NO: 178832
  derived and/or modified sequence opt4 from neuraminidase__InfluenzaA__EPI328899

SEQ ID NO: 178835 - RNA, 1410 nt, Artificial Sequence; identical to SEQ ID NO: 178832
  derived and/or modified sequence opt4 from neuraminidase__InfluenzaA__EPI328901

SEQ ID NO: 178836 - RNA, 1410 nt, Artificial Sequence
  derived and/or modified sequence opt4 from neuraminidase__InfluenzaA__EPI574645
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccagguggugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacggccacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucauccacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaacgaggugcuguggaccagcaacagcaucgugguguucugcggcaccagcggcaccuacggcaccggcagcuggcccgacggcgccgaccugaaccugaugcccaucuga

SEQ ID NO: 178837 - RNA, 1410 nt, Artificial Sequence
  derived and/or modified sequence opt4 from neuraminidase__InfluenzaA__EPI563214
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcagcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucguguacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugguggagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178838 - RNA, 1410 nt, Artificial Sequence; identical to SEQ ID NO: 178837
  derived and/or modified sequence opt4 from neuraminidase__InfluenzaA__EPI553998

SEQ ID NO: 178839 - RNA, 1410 nt, Artificial Sequence
  derived and/or modified sequence opt4 from neuraminidase__InfluenzaA__EPI551568
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcagcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaucgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucguguacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugguggagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178840 - RNA, 1410 nt, Artificial Sequence
  derived and/or modified sequence opt4 from neuraminidase__InfluenzaA__EPI629737
augaaccccaaccagaagaucaucgccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcagcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucguguacaccagcaagcugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugguggagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178841 - RNA, 1410 nt, Artificial Sequence; identical to SEQ ID NO: 178837
  derived and/or modified sequence opt4 from neuraminidase__InfluenzaA__EPI631886

SEQ ID NO: 178842 - RNA, 1410 nt, Artificial Sequence; identical to SEQ ID NO: 178837
  derived and/or modified sequence opt4 from neuraminidase__InfluenzaA__EPI577025

SEQ ID NO: 178843 - RNA, 1410 nt, Artificial Sequence; identical to SEQ ID NO: 176391
  derived and/or modified sequence opt4 from neuraminidase__InfluenzaA__EPI404926

SEQ ID NO: 178844 - RNA, 1410 nt, Artificial Sequence; identical to SEQ ID NO: 176391
  derived and/or modified sequence opt4 from neuraminidase__InfluenzaA__EPI492687

SEQ ID NO: 178845 - RNA, 1410 nt, Artificial Sequence
  derived and/or modified sequence opt4 from neuraminidase__InfluenzaA__EPI530648
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaccaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178846 - RNA, 1410 nt, Artificial Sequence; identical to SEQ ID NO: 178827
  derived and/or modified sequence opt4 from neuraminidase__InfluenzaA__EPI684314

SEQ ID NO: 178847 - RNA, 1410 nt, Artificial Sequence
  derived and/or modified sequence opt4 from neuraminidase__InfluenzaA__EPI614459
augaaccccaaccagaagaucaucaccaucggcagcgugagccugaccaucagcaccaucugcuucuucaugcagaucgccauccugaucaccaccgugacccugcacuucaagcaguacaaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaccaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178848 - RNA, 1410 nt, Artificial Sequence; identical to SEQ ID NO: 178847
  derived and/or modified sequence opt4 from neuraminidase__InfluenzaA__EPI541466

SEQ ID NO: 178849 - RNA, 1410 nt, Artificial Sequence; identical to SEQ ID NO: 178847
  derived and/or modified sequence opt4 from neuraminidase__InfluenzaA__EPI696968

SEQ ID NO: 178850 - RNA, 1410 nt, Artificial Sequence; identical to SEQ ID NO: 178847
  derived and/or modified sequence opt4 from neuraminidase__InfluenzaA__EPI674598

SEQ ID NO: 178851 - RNA, 1410 nt, Artificial Sequence; identical to SEQ ID NO: 178845
  derived and/or modified sequence opt4 from neuraminidase__InfluenzaA__EPI530678

SEQ ID NO: 178852 - RNA, 1410 nt, Artificial Sequence
  derived and/or modified sequence opt4 from neuraminidase__InfluenzaA__EPI530680
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugagagacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggacauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacggcguguggaugggcagaaccaucaacgagaccagcagacugggcuacgagaccuucaaggugaucgagggcuggagcaaccccaagagcaagcugcagaccaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178853 - RNA, 1410 nt, Artificial Sequence; identical to SEQ ID NO: 166558
  derived and/or modified sequence opt4 from neuraminidase__InfluenzaA__EPI7603

SEQ ID NO: 178854 - RNA, 1410 nt, Artificial Sequence; identical to SEQ ID NO: 178845
  derived and/or modified sequence opt4 from neuraminidase__InfluenzaA__EPI814527

SEQ ID NO: 178855 - RNA, 1410 nt, Artificial Sequence; identical to SEQ ID NO: 178845
  derived and/or modified sequence opt4 from neuraminidase__InfluenzaA__EPI674737

SEQ ID NO: 178856 - RNA, 1410 nt, Artificial Sequence; identical to SEQ ID NO: 178845
  derived and/or modified sequence opt4 from neuraminidase__InfluenzaA__EPI614443

SEQ ID NO: 178857 - RNA, 1410 nt, Artificial Sequence; identical to SEQ ID NO: 178845
  derived and/or modified sequence opt4 from neuraminidase__InfluenzaA__EPI551812

SEQ ID NO: 178858 - RNA, 1410 nt, Artificial Sequence; identical to SEQ ID NO: 178845
  derived and/or modified sequence opt4 from neuraminidase__InfluenzaA__EPI696961

SEQ ID NO: 178859 - RNA, 1410 nt, Artificial Sequence; identical to SEQ ID NO: 178845
  derived and/or modified sequence opt4 from neuraminidase__InfluenzaA__EPI740789

SEQ ID NO: 178860 - RNA, 1410 nt, Artificial Sequence
  derived and/or modified sequence opt4 from neuraminidase__InfluenzaA__EPI377498
augaaccccaaccagaagaucaucaccaucggcagcgugagccugaccaucagcaccaucugcuucuucaugcagaucgccauccugaucaccaccgugacccugcacuucaagcaguacgaguucaacagcccccccaacaaccaggugaugcugugcgagcccaccaucaucgagagaaacaucaccgagaucguguaccugaccaacaccaccaucgagaaggagaucugccccaagcccgccgaguacagaaacuggagcaagccccagugcggcaucaccggcuucgcccccuucagcaaggacaacagcaucagacugagcgccggcggcgacaucugggugaccagagagcccuacgugagcugcgaccccgacaagugcuaccaguucgcccugggccagggcaccacccugaacaacgugcacagcaacaacaccgugcacgacagaacccccuacagaacccugcugaugaacgagcugggcgugcccuuccaccugggcaccaagcaggugugcaucgccuggagcagcagcagcugccacgacggcaaggccuggcugcacgugugcaucaccggcgacgacaagaacgccaccgccagcuucaucuacaacggcagacugguggacagcguggugagcuggagcaaggagauccugagaacccaggagagcgagugcgugugcaucaacggcaccugcaccguggugaugaccgacggcagcgccagcggcaaggccgacaccaagauccuguucaucgaggagggcaagaucgugcacaccagcacccugagcggcagcgcccagcacguggaggagugcagcugcuaccccagauaccccggcgugagaugcgugugcagagacaacuggaagggcagcaacagacccaucguggacaucaacaucaaggaccacagcaucgugagcagcuacgugugcagcggccuggugggcgacacccccagaaagaacgacagcagcagcagcagccacugccuggaccccaacaacgaggagggcggccacggcgugaagggcugggccuucgacgacggcaacgacguguggaugggcagaaccaucaacgagaccagcagacugggcuacgagaccuucaaggugaucgagggcuggagcaaccccaagagcaagcugcagaucaacagacaggugaucguggacagaggcgacagaagcggcuacagcggcaucuucagcguggagggcaagagcugcaucaacagaugcuucuacguggagcugaucagaggcagaaaggaggagaccgaggugcuguggaccagcaacagcaucgugguguucugcggcaccagcggcaccuacggcaccggcagcuggcccgacggcgccgaccugaaccugaugcccaucuga

SEQ ID NO: 178861 - RNA, 1410 nt, Artificial Sequence; identical to SEQ ID NO: 178860
  derived and/or modified sequence opt4 from neuraminidase__InfluenzaA__EPI377498

SEQ ID NO: 178862 - RNA, 1410 nt, Artificial Sequence; identical to SEQ ID NO: 178860
  derived and/or modified sequence opt4 from neuraminidase__InfluenzaA__EPI391246

SEQ ID NO: 178863 - RNA, 1410 nt, Artificial Sequence; identical to SEQ ID NO: 178860
  derived and/or modified sequence opt4 from neuraminidase__InfluenzaA__EPI407122

SEQ ID NO: 178864 - RNA, 1410 nt, Artificial Sequence; identical to SEQ ID NO: 178860
  derived and/or modified sequence opt4 from neuraminidase__InfluenzaA__EPI407125

SEQ ID NO: 178865 - RNA, 1410 nt, Artificial Sequence; identical to SEQ ID NO: 178827
  derived and/or modified sequence opt4 from neuraminidase__InfluenzaA__EPI562038

SEQ ID NO: 178866 - RNA, 1410 nt, Artificial Sequence; identical to SEQ ID NO: 178827
  derived and/or modified sequence opt4 from neuraminidase__InfluenzaA__EPI562038

SEQ ID NO: 178867 - RNA, 1410 nt, Artificial Sequence; identical to SEQ ID NO: 175137
  derived and/or modified sequence opt4 from neuraminidase__InfluenzaA__EU716525

SEQ ID NO: 178868 - RNA, 1350 nt, Artificial Sequence
  derived and/or modified sequence opt4 from neuraminidase__InfluenzaA__EPI232422
augaaccccaaccagaagaucaucaccaucggcagcaucugcauggugaucggcaucgugagccugaugcugcagaucggcaacaugaucagcaucugggugagccacagcauccagaccggcaaccagagacaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178869 - RNA, 1350 nt, Artificial Sequence; identical to SEQ ID NO: 178704
  derived and/or modified sequence opt4 from neuraminidase__InfluenzaA__EPI227593

SEQ ID NO: 178870 - RNA, 1350 nt, Artificial Sequence
  derived and/or modified sequence opt4 from neuraminidase__InfluenzaA__EPI435658
augaaccccaaccagaagaucgugaccaucggcagcaucugcauggugaucggcaucaucagccugaugcugcagaucggcaacaucaucagcaucugggugagccacagcauccagaccggcaaccagcaccagaccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccaucggcgaggcccccagccccuacaacagcagauucgagagcguggccuggagcgccagcgccugccacgacggcaccagcuggcugaucaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaucgagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcacccacagcagaagcggcuucgagaugaucugggaccccaacggcuggaccggcaccgacagcgaguucagcaugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178871 - RNA, 1350 nt, Artificial Sequence; identical to SEQ ID NO: 178870
  derived and/or modified sequence opt4 from neuraminidase__InfluenzaA__EPI492513

SEQ ID NO: 178872 - RNA, 1350 nt, Artificial Sequence; identical to SEQ ID NO: 172217
  derived and/or modified sequence opt4 from neuraminidase__InfluenzaA__EPI165066

SEQ ID NO: 178873 - RNA, 1350 nt, Artificial Sequence
  derived and/or modified sequence opt4 from neuraminidase__InfluenzaA__EPI531308
augaaccccaaccagaagaucaucaccaucggcagcaucugcauggugaccggcguggugagccugaugcugcaggugggcaacaugaucagcaucuggaucagccacagcauccacaccggcaaccagcaccaggccgagcccaucagcaacaccaacuuccacaccgagaaggccguggugagcgccaagcuggccggcaacagcagccugugccccaucaacggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgccaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacgugcugagaacccaggagagcgagugcgccugcgugaacggcuacugcuucaccgugaugaccgacggccccagcaacggccaggccagccacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccuggaucagcuucaaccagaaccuggaguaccagaucggcuacaucugcagcggcguguucggcgacaaccccagacccaacgacggcaagggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagggcaccaucuggaccagcggcagcagcaucagcuucugcggcgugagcggcgacaccgugggcuggagcuggcccgacggcgccgagcugcccuucaccaucgacaaguga

SEQ ID NO: 178874 - RNA, 1350 nt, Artificial Sequence
  derived and/or modified sequence opt4 from neuraminidase__InfluenzaA__EPI433308
augaaccccaaccagaagaucaucaccaucggcagcaucugcauggugaucggcaucgugagccugaugcugcagaucggcaaccugaucagcaucugggugagccacagcauccagagaggcaaccugaaccagguggagcccaucagcaacaccagcuuccccaccgagaaggccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggggcaacaacauccugagaacccaggagagcgagugcgccugcgugaacggcagcugcuucaccgugaugaccgacggccccagcaacggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagccccaacagcagaagcggcuucgagaugaucugggaccccaacggcuggagcgagaccgacagcagcuucagcgugaagcaggacauccuggccgugaccgacuggagcggcuacagcggcagcuucgugcagcaccccgagcugaccggccuggacugcaucagacccugcuucuggguggagcugaucagaggcagacccgaggagagcaccaucuggaccagcggcagcagcaucagcuucugcggcgugaacagcgacaccgugagcuggagcuggcccgacggcgccgagcugcccuucaccaucgacaaguga

SEQ ID NO: 178875 - RNA, 1350 nt, Artificial Sequence
  derived and/or modified sequence opt4 from neuraminidase__InfluenzaA__EPI114974
augaaccccaaccagaagaucaucaccaucggcagcaucugcauggugaucggcaucgugagccugaugcugcagaucggcaacaugaucagcaucugggugagccacagcauccagaccggcaaccagagacaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcaucgagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178876 - RNA, 1350 nt, Artificial Sequence
  derived and/or modified sequence opt4 from neuraminidase__InfluenzaA__EPI622495
augaaccccaaccagaagaucaccaccaucggcagcaucugcauggugaucggcaucgugagccugaugcugcagaucggcaacauggugagcaucugggugagccacagcauccagaccagaaaccagagacaggccgagcccaucagcaacaccagaagccugaccgagaaggccguggccagcgugacccuggccggcaacagcagccugugccccaucagcggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgugugcgugaacggcagcugcuucaccgugaugaccgacggccccagcaacaagcaggccagcuacaagaucuucaagauggagaagggcaagguggugaagagcaucgagcuggacgcccccaacuaccacuacgaggagugcagcugcuaccccgacgccggcgagaucaccugcgugugcagagacaacuggcacggcagcaacagacccuggcugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcaugaagcaggacaucguggccaucaccgacuggagcggcuacagcggcagcuucgugcagcaccccgagcugaccggccuggacugcaucagacccugcuucuggguggagcuggugagaggcagacccaaggagggcaccaucuggaccagcggcagcagcaucagcuucugcggcgugaacagcgacaccgugagcuggagcuggcccgacggcgccgagcugcccuucaccaucgacaaguga

SEQ ID NO: 178877 - RNA, 1350 nt, Artificial Sequence
  derived and/or modified sequence opt4 from neuraminidase__InfluenzaA__EPI349847
augaaccccaaccagaagaucaccaccaucggcagcaucugcauggugaucggcaucgugagccugaugcugcagaucggcaacauggugagcaucugggugagccacagcauccagaccagaaaccagagacaggccgagcccaucagcaacaccagaagccugaccgagaaggccguggccagcgugacccuggccggcaacagcagccugugccccaucagcggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccguggugaaguacaacggcaucaucaccgacaccaucaagagcuggagaaacaacauccugagaacccaggagagcgagugcgugugcgugaacggcagcugcuucaccgugaugaccgacggccccagcaacaagcaggccagcuacaagaucuucaagauggagaagggcaagguggugaagagcaucgagcuggacgcccccaacuaccacuacgaggagugcagcugcuaccccgacgccggcgagaucaccugcgugugcagagacaacuggcacggcagcaacagacccuggcugagcuucaaccagaaccuggaguaccagaucggcuacaucugcagcggcguguucggcgacaaccccagacccaacgacggcaccggcagcugcggccccgugagccacaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcaugaagcaggacaucguggccaucaccgacuggagcggcuacagcggcagcuucgugcagcaccccgagcugaccggccuggacugcaucagacccugcuucuggguggagcuggugagaggcagacccaaggagggcaccaucuggaccagcggcagcagcaucagcuucugcggcgugaacagcgacaccgugagcuggagcuggcccgacggcgccgagcugcccuucaccaucgacaaguga

SEQ ID NO: 178878 - RNA, 1350 nt, Artificial Sequence
  derived and/or modified sequence opt4 from neuraminidase__InfluenzaA__EPI174804
augaaccccaaccagaagaucaucaccaucggcagcaucugcauggugaucggcaucgugagccugaugcugcagaucggcaacauggugagcaucugggugagccacagcauccagaccagaaaccagagacaggccgagcccaucagcaacaccaagagccugaccgagaaggccguggccagcgugacccuggccggcaacagcagccugugccccaucagcggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucgccgugaugaccgacggccccagcaacagacaggccagcuacaagaucuucaagauggagaagggcaagguggugaagagcaucgagcuggacgcccccaacuaccacuacgaggagugcagcugcuaccccgacgccggcgagaucaccugcgugugcagagacaacuggcacggcagcaacagacccuggcugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcaugaagcaggacaucguggccaucaccgacuggagcggcuacagcggcagcuucgugcagcaccccgagcugaccggccuggacugcaucagacccugcuucuggguggagcuggugagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178879 - RNA, 1350 nt, Artificial Sequence
  derived and/or modified sequence opt4 from neuraminidase__InfluenzaA__EPI492441
augaaccccaaccagaagaucauggccaucggcagcgugugcauggugaucggcaucgugagccugaugcugcagaucggcaacaccaucagcaucugggugagccacagcuuccagaccagagugcagcaccaggccgagcccaucagaaacaccaacuuccugaccgagaacgccguggccagcgugacccuggccggcaacagcagccugugccccaucagaggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacagaaccgugaaggacagaagcccccacagaacccugaugagcugccccgugggcgaggugcccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcuucugcuucaccgugaugaccgacggccccagcaacggccaggccagcuacaagaucuucaagaugaagaagggcaagguggugaagagcguggagcugaacgcccccaacuaccacuacgaggagugcagcugcuaccccgacgccggcgagaucaugugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcaucaagggcuucagcuucaaguacggcaacggcguguggaucggcagaaccaagagcaccaacagcagaagcggcuucgagauggugugggaccccaacggcuggaccgacaccgacagcgacuucagcaucaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgagaccgugagcuggagcuggcccgacggcgccgagcugcccuucaccaucgacaaguga

SEQ ID NO: 178880 - RNA, 1350 nt, Artificial Sequence; identical to SEQ ID NO: 178507
  derived and/or modified sequence opt4 from neuraminidase__InfluenzaA__EPI164142

SEQ ID NO: 178881 - RNA, 1350 nt, Artificial Sequence
  derived and/or modified sequence opt4 from neuraminidase__InfluenzaA__EPI827076
augaaccccaaccagaagaucgugaccaucggcagcaucugcauggugaucggcaucaucagccugaugcugcagaucggcaacaucaucagcaucugggugagccacagcauccagaccggcaaccagcaccagaccgagcccaucagaaacaccaacuuccugaccgagaacgccguggccagcgugacccuggccggcaacagcagccugugccccaucaagggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccaucggcgaggcccccagccccuacaacagcagauucgagagcguggccuggagcgccagcgccugccacgacggcaccagcuggcugaucaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucgccgugaugaccgacggccccagcaacggccaggccagcuacaagaucuucaagaucgagaagggcaagguggugaagagcguggagcugaacgcccccaacuaccacuacgaggagugcagcugcuaccccgacgccggcgagaucaucugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagcagcaacggcgccuacggcgugaagggcuucagcuucaaguacggcaacggcguguggaucggcagaaccaagagcacccacagcagaagcggcuucgagaugaucugggaccccaacggcuggaccggcaccgacagcgaguucagcaugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178882 - RNA, 1350 nt, Artificial Sequence; identical to SEQ ID NO: 169099
  derived and/or modified sequence opt4 from neuraminidase__InfluenzaA__EPI168491

SEQ ID NO: 178883 - RNA, 1350 nt, Artificial Sequence
  derived and/or modified sequence opt4 from neuraminidase__InfluenzaA__EPI827078
augaaccccaaccagaagaucaucaccaucggcagcaucugcauggugaucggcaucgccagccugaugcugcagaucggcaacaucaucagcaucuggaucagccacagcauccagaccggcaaccagugccagaacgagagcaucagcaacaccaaguuccuggccgagaaggccguggccagcgugacccuggccggcaacagcagccugugccccgugagcggcugggccguguacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacagcggcgccguggccgugcugaaguacaacggcaucaucaccgacaccaucaagagcuggagaaacaacaucaugagaacccaggagagcgagugcgccugcgugaacggcagcugcuucaccaucaugaccgacggccccagcagcggccaggccagcuacaagaucuucaagauggagaagggcaaggugaucaagagcguggagcuggacgcccccaacuaccacuacgaggagugcagcugcuaccccgacgccggcgagaucaccugcgugugcagagacaacuggcacggcagcaacagacccuggaucagcuucaaccagaaccuggaguaccagaucggcuacaucugcagcggcguguucggcgacaaccccagacccaacgacggcaccggcagcugcggccccguguuccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgaguggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacggcgacaccgugagcuggagcuggcccgacggcgccgagcugcccuucaccaucgacaaguga

SEQ ID NO: 178884 - RNA, 1350 nt, Artificial Sequence
  derived and/or modified sequence opt4 from neuraminidase__InfluenzaA__EPI594521
augaaccccaaccagaagaucaucaccaucggcagcaucugcgugggcaucggcaucgugagccugaugcugcagaucggcaacauggugagcaucugggugaaccacagcauccagaccgagaaccagugccaggccgagagcaucagcaacaccaaguuccugaccgagaaggccguggcccccgugacccugaugggcaacagcagccugugccccaucagcggcugggccgugcacagcaaggacaacagcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagagcccugaugagcugccccgugggcgaggcccccagccccuacaacagcagauucgagagcguggccuggagcgccagcgccugccacgacggcaccggcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagcuggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacggcgccgaggugcccuucaccaucgacaaguga

SEQ ID NO: 178885 - RNA, 1410 nt, Artificial Sequence
  derived and/or modified sequence opt4 from neuraminidase__InfluenzaA__EPI5787
augaaccccaaccagaagaucaucaccaucggcagcaucugcaugguggugggcaucaucagccugaugcugcagaucggcaacaucaucagcaucugggugagccacagcauccagaccggcaaccagcaccaggccgagcccugcaaccagagcaucaucaccuacgagaacaacaccugggugaaccagaccuacgugaacaucagcaacaccaacuuccugaccgagaaggccguggccagcgugacccuggccggcaacagcagccugugccccaucagcggcugggccgugcacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagauggagaagggcaagguggugaagagcguggagcugaacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugggcuggagcuggcccgacgacgccgagcugcccuucaccaucgacaaguga

SEQ ID NO: 178886 - RNA, 1410 nt, Artificial Sequence; identical to SEQ ID NO: 178885
  derived and/or modified sequence opt4 from neuraminidase__InfluenzaA__EPI5787

SEQ ID NO: 178887 - RNA, 1350 nt, Artificial Sequence; identical to SEQ ID NO: 173585
  derived and/or modified sequence opt4 from neuraminidase__InfluenzaA__EPI267031

SEQ ID NO: 178888 - RNA, 1350 nt, Artificial Sequence; identical to SEQ ID NO: 175165
  derived and/or modified sequence opt4 from neuraminidase__InfluenzaA__EPI376539

SEQ ID NO: 178889 - RNA, 1350 nt, Artificial Sequence
  derived and/or modified sequence opt4 from neuraminidase__InfluenzaA__EPI124069
augaaccccaaccagaagaucaucaccaucggcagcaucugcauggugaucggcaucgugagccugaugcugcagaucggcaacaugaucagcaucugggugagccacagcauccagaccggcaaccagcaccaggccgagagcaucagcaacaccaacccccugaccgagaaggccguggccagcgugacccuggccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcgacggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178890 - RNA, 1350 nt, Artificial Sequence
  derived and/or modified sequence opt4 from neuraminidase__InfluenzaA__EPI342499
augaaccccaaccagaagaucaucaccaucggcagcaucugcauggugaucggcaucgugagccugaugcugcagaucggcaacaugaucagcaucuggaucagccacagcauccagaagggcaaccagcacagaaccgagagcaucagcaacaccaacccccugaccgagaaggccguggccagcgugacccugaccggcaacagcagccugugccccaucagaggcugggccgugcacagcaaggacaacaacaucagaaucggcagcaagggcgacguguucgugaucagagagcccuucaucagcugcagccaccuggagugcagaaccuucuuccugacccagggcgcccugcugaacgacaagcacagcaacggcaccgugaaggacagaagcccccacagaacccugaugagcugcccccugggcgaggcccccagccccuacaacagcagauucgagagcguggccuggagcgccagcgccugccacgacggcaccggcuggcugaccaucggcaucagcggccccgacaacgaggccguggccgugcugaaguacaacggcaucaucaccgacaccaucaagagcuggagaaacaacauccugagaacccaggagagcgagugcgccugcgugaacggcagcugcuucaccgugaugaccgacggccccagcaacggccaggccagcuacaagaucuucaagaugagaaagggcaagguggugaagagcguggagcuggacgcccccaacuaccacuacgaggagugcagcugcuaccccgacaccggcgagaucaccugcgugugcagagacaacuggcacggcagcaacagacccuggaucagcuucaaccagaaccuggaguaccagaucggcuacaucugcagcggcaucuucggcgacaaccccagacccaacgacggcaccggcagcugcggccccaugagccccaacggcgccuacggcgugaagggcuucagcuucaaguacggcaacggcguguggaucggcagaaccaagagcaccaacagcagaagcggcuucgagaugaucugggaccccaacggcuggaccgagaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178891 - RNA, 1350 nt, Artificial Sequence
  derived and/or modified sequence opt4 from neuraminidase__InfluenzaA__EPI103069
augaaccccaaccagaagaucaucaccaucggcagcaucugcauggugaucggcaucgugagccugaugcugcagaucggcaacaugaucagcaucugggugagccacagcauccagaccggcaaccagagacaggccgagcccaucagcaacaccaaguuccugaccgagaaggccguggccagcgugacccuggccggcaacagcagccugugccccaucagcggcugggccguguacagcaaggacaacagcaucagaaucggcagcagaggcgacguguucgugaucagagagcccuucaucagcugcagccaccuggagugcagaaccuucuuccugacccagggcgcccugcugaacgacaagcacagcaacggcaccaucaaggacagaagcccccacagaacccugaugagcugccccgugggcgaggcccccagccccuacaacagcagauucgagagcguggccuggagcgccagcgccugccacgacggcaccagcuggcugaccaucggcaucagcggccccgacaacggcgccguggccgugcugaaguacaacggcaucaucaccgacaccaucaagagcuggagaaacaacauccugagaacccaggagagcgagugcgccugcgugaacggcagcugcuucaccgugaugaccgacggccccagcagcggccaggccagcuacaagaucuucaagauggagaagggcaagguggugaagagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaucggcuacaucugcagcggcguguucggcgacaaccccagacccaacgacggcaccggcagcugcggccccgugagccccaacggcgccuacggcgugaagggcuucagcuucaaguacggcaacggcguguggaucggcagaaccaagagcaccaacagcagaagcggcuucgagaugaucugggaccccaacggcuggaccggcaccgacagcagcuucagcgugaagcaggacaucguggccaucaccgacuggagcggcuacagcggcagcuucgugcagcaccccgagcugaccggccuggacugcaucagacccugcuucuggguggagcugaucagaggcagacccaaggagagcaccaucuggaccagcggcagcagcaucagcuucugcggcgugaacagcgacaccgugagcuggagcuggcccgacggcgccgagcugcccuucaccaucgacaaguga

SEQ ID NO: 178892 - RNA, 1350 nt, Artificial Sequence; identical to SEQ ID NO: 178868
  derived and/or modified sequence opt4 from neuraminidase__InfluenzaA__EPI227595

SEQ ID NO: 178893 - RNA, 1410 nt, Artificial Sequence
  derived and/or modified sequence opt4 from neuraminidase__InfluenzaA__EPI569385
augaaccccaaccagaagaucaucaccaucggcagcgugagccugaccaucgccaccgugugcuuccugaugcagaucgccauccuggccaccaccgugacccugcacuucaagcagaacgagugcagcaucccccccaacaaccagguggugcccugcgagcccaucaucaucgagaagaacaucaccgagaucguguaccugaacaacaccaccaucgagaaggaggugugccccgaggugcccgaguacagaaacuggagcaagccccagugccagaucaccggcuucgcccccuucagcaaggacaacagcaucagacugagcgccggcggcgacaucugggugaccagagagcccuacgugagcugcagccccggcaagugcuaccaguucgcccugggccagggcaccacccugaacaacaagcacagcaacggcaccauccacgacagaaucccccacagaacccugcugaugagcgagcugggcgugcccuuccaccugggcaccaagcaggugugcaucgccuggagcagcagcagcugccacgacggcaaggccuggcugcacgugugcgugaccggcgacgacagaaacgccaccgccagcuucaucuacgacggcaugcuggccgacagcaucggcagcuggagccagaacauccugagaacccaggagagcgagugcgugugcaucaacggcaccugcaccguggugaugaccgacggcagcgccagcggcagagccgacaccagaauccuguucaucaaggagggcaagaucgugcacaucagcccccugagcggcagcgcccagcacaucgaggagugcagcugcuaccccagauaccccgacgugagaugcgugugcagagacaacuggaagggcagcaacagacccgugaucgacaucaacauggccgacuacagcaucgacagcagcuacgugugcagcggccuggugggcgacacccccagaaacgacgacagcagcagcagcagcaacugcagagaccccaacaacgagagaggcaaccccggcgugaagggcugggccuucgacaacggcaacgacguguggaugggcagaaccaucagcgaggacagcagaagcggcuacgagaccuucagagugaccgacggcuggaccaccgccaacagcaagagccaggugaacagacagaucaucguggacaacaacaacuggagcggcuacagcggcaucuucagcguggagggcaagagcugcaucaacagaugcuucuacguggagcugaucagaggcagaccccaggagaccagagugugguggaccagcaacagcaucgugguguucugcggcaccagcggcaccuacggcaccggcagcuggcccgacggcgccaacaucaacuucaugcccaucuga

SEQ ID NO: 178894 - RNA, 1380 nt, Artificial Sequence
  derived and/or modified sequence opt4 from neuraminidase__InfluenzaA__EPI736916
augaaccccaaccagaagaucaccugcaucagcgccaccggcgugacccugagcguggugagccugcugaucggcaucgccaaccugggccugaacaucggccugcacuacaaggugagcgacagcaccaccaucagcauccccaacaugaacgagaccaaccccaccaccaccaacaucaccaacaucaucgugaacaagaacgaggagagaaccuuccugaaccugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggcagacacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggccggcaacauccugagaacccaggagagcgagugcgugugccacaagggcaucugccccguggugaugaccgacggccccgccaacaacaaggccgccaccaagaucaucuacuucaaggagggcaaggugcagaagaucgaggagcugcagggcaacgcccagcacaucgaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggccccaccagcuaccagcugaucgugaacaaccagaacuggagcggcuacagcggcgccuucaucgacuacugggccaacaaggagugcuucaaccccugcuucuacguggagcugaucagaggcagacccaaggagagcgacgugcuguggaccagcaacagcaugguggcccugugcggcagcagagagagacugggcagcuggagcuggcacgacggcgccgagaucaucuacuucaaguga

SEQ ID NO: 178895 - RNA, 1380 nt, Artificial Sequence; identical to SEQ ID NO: 178514
  derived and/or modified sequence opt4 from neuraminidase__InfluenzaA__EPI593891

SEQ ID NO: 178896 - RNA, 1380 nt, Artificial Sequence
  derived and/or modified sequence opt4 from neuraminidase__InfluenzaA__EPI691380
augaaccccaaccagaagaucgugugcaucagcgugaccggcgugacccugagcguggugagccugcugaucggcaucaccaaccugggccugaacaucggccugcacuacaaggugagcgacagcaccaccaucaacauccccaacaugaacgagaccaaccccaccaccaccaacaucaccaacaucaucaugaacaagaacgaggagagaaccuuccugaagcugaccaagccccugugcgaggugaacagcuggcacauccugagcaaggacaacgccaucagaaucggcgaggacgcccacauccuggugaccagagagcccuaccugagcugcgacccccagggcugcagaauguucgcccugagccagggcaccacccugagaggccagcacgccaacggcaccauccacgacagaagccccuucagagcccugaucagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacagaggcagacccgugaccgagauccccagcugggccggcaacauccugagaacccaggagagcgagugcgugugccacaagggcaucugccccguggugaugaccgacggccccgccaacaacaaggccgccaccaagaucaucuacuucaaggagggcaagauccagaagaccgaggagcugcagggcaacgcccagcacaucgaggagugcagcugcuacggcgccgccggcaugaucaagugcgugugcagagacaacuggaagggcgccaacagacccaucaucaccaucgaccccgagaugaugacccacaccagcaaguaccugugcagcaagauccugaccgacaccagcagacccaacgaccccaccaacggcaacugcgacgcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaucgacauccagagcggccccaucagcuaccagcugguggugaacaaccagaacuggagcggcuacagcggcgccuucaucgacuacugggccaacaaggagugcuucaaccccugcuucuacguggagcugaucagaggcagacccaaggagagcggcgugcuguggaccagcaacagcaugguggcccugugcggcagcagagagagacugggcagcuggagcuggcacgacggcgccgagaucaucuacuucaaguga

SEQ ID NO: 178897 - RNA, 1413 nt, Artificial Sequence
  derived and/or modified sequence opt4 from neuraminidase__InfluenzaA__EPI533584
augaaccccaaccagaagaucaccugcaucagcgccaccggcaugacccugagcguggugagcaugcugaucggcaucgccaaccugggccugaacaucggccugcacuacaaggugagcgacagcaccaacaucaacauccccaacaugaacgagaccagccccaccaccaccaucaucaacaaccacccccagaacaacuucaccaacaucaccaacaucaucgugaccaagaacgaggagggccaccugcugaaccugaccaagccccugugcgaggugaacagcuggcacauccugagcaaggacaacgccaucagaaucggcgaggacgcccacaucaucgugaccagagagcccuaccugagcugcgacccccagggcugcagaauguucgcccugagccagggcaccacccugagaggcaagcacgccaacggcaccauccacgacagaagccccuucagagcccuggugagcugggagaugggccaggcccccagccccuacaacaccagaguggagugcaucggcuggagcagcaccagcugccacgacggcaucagcagaaugagcaucugcaucagcggccccaacaacaacgccagcgccguggugugguacggcggcagacccgugaccgagauccccagcugggccggcaacauccugagaacccaggagagcgagugcgugugccacggcggcaucugccccguggugaugaccgacggccccgccaacaacagagccgagaccaagaucaucuacuucaaggagggcaagaucaagaagaucgaggagcugaagggcgacgcccagcacaucgaggagugcagcugcuacggcgccagcgagaugaucaagugcaucugcagagacaacuggaagggcgccaacagacccgugaucaccaucgaccccgagaugaugacccacaccagcaaguaccugugcagcaagauccugaccgacaccagcagacccaacgaccccaccaacggcaagugcgaggcccccaucaccggcggcagccccgaccccggcgugaagggcuucgccuuccuggacggcgagaacagcuggcugggcagaaccaucagcaaggacagcagaagcggcuacgagaugcugaaggugcccaacgccgagaccgacacccagagcggcgccaucagccaccagaucaucgugaacaaccagaacuggagcggcuacagcggcgccuucaucgacuacugggccaacaaggagugcuucaaccccugcuucuacguggagcugaucagaggcagacccaaggagagcagcgugcuguggaccagcaacagcaucguggcccugugcggcagcaaggagagacugggcagcuggagcuggcacgacggcgccgagaucaucuacuucaaguga

SEQ ID NO: 178898 - RNA, 1380 nt, Artificial Sequence; identical to SEQ ID NO: 178518
  derived and/or modified sequence opt4 from neuraminidase__InfluenzaA__EPI641400

SEQ ID NO: 178899 - RNA, 1380 nt, Artificial Sequence; identical to SEQ ID NO: 178518
  derived and/or modified sequence opt4 from neuraminidase__InfluenzaA__EPI587620

SEQ ID NO: 178900 - RNA, 1410 nt, Artificial Sequence
  derived and/or modified sequence opt4 from neuraminidase__InfluenzaA__EPI569392
augaaccccaaccagaagaucgugaccaucggcagccugagccugggccuggugguguucaacgugcugcugcacgccgugagcaucauccugaccgugcuggcccugggcaagagcgagaacaacggcaucugcaacggcaccguggugagagaguacaacgagaccgugagaaucgagaaggugacccagugguacaacaccagcgugguggaguacgugccccacuggaacgagggcaccuacaucaacaacaccgagcccaucugcgacgugaagggcuucgcccccuucagcaaggacaacggcaucagagugggcagcagaggccacaucuucgugaucagagagcccuucgugagcugcagccccgugggcugcagaaccuucuuccugacccagggcagccugcugaacgacaagcacagcaacggcaccgugaaggacagaagccccuucagaacccugaugagcguggaggugggccagagccccaacguguaccaggccagauucgaggccguggccuggagcgccaccgccugccacgacggcaagaaguggauggccaucggcgugaccggccccgacagcaaggccguggccguggugcacuacggcggcgugcccaccgacguggugaacagcugggccggcgacauccugagaacccaggagagcagcugcaccugcauccagggcaacugcuacugggugaugaccgacggccccgccaacagacaggcccaguacagaaucuacaaggccaaccagggcaagaucaucggcagaaaggacgugagcuucagcggcggccacaucgaggagugcagcugcuaccccaacgacggcaagguggagugcgugugcagagacaacuggaccggcaccaacagacccgugcugaucaucagccccgaccugagcuacagagugggcuaccugugcgccggccugcccagcgacacccccagaggcgaggacacccaguucgugggcagcugcaccagccccaugggcaaccagggcuacggcgugaagggcuucggcuucagacagggcaccgacgugugggugggcagaaccaucagcagaaccagcagaagcggcuucgagaucaucagaaucaagaacggcuggacccagaccagcaaggagcagaucagaagacagguggugguggacaacagcaacuggagcggcuacagcggcagcuucacccugcccguggagcugagcggcagagagugccuggugcccugcuucuggguggagaugaucagaggcagacccgaggagagaaccaucuggaccagcagcagcagcaucgugaugugcggcguggacuacgagaucgccgacuggagcuggcacgacggcgccauccugcccuucgacaucgacaaguga

SEQ ID NO: 178901 - RNA, 1368 nt, Artificial Sequence
  derived and/or modified sequence opt4 from neuraminidase__InfluenzaA__EPI459857
augaaccccaaccagaagaucaucaccaucggcagcaucugcauggugaucggcaccgugagccugaucgugcaggugggcaacaucauccugaucugggugaaccacagcauccagaccugcaucaccuacgagaacaacaccugggugaaccagaccuacgugagcaacaccaacuuccugaccggccaggccguggccagcgugacccuggccggcaacagcagccugugccccaucagcggcugggccaucuacagcaaggacaacggcaucagaaucggcagcaagggcgacguguucgugaucagagagcccuucaucagcugcagccaccuggagugcagaaccuucuuccugacccagggcgcccugcugaacgacaagcacagcaacggcaccaucaaggacagaagccccuacagaacccugaugagcugccccgugggcgaggcccccagccccuacaacagcagauucgagagcguggccuggagcgccagcgccugccacgacggcaucaacuggcugaccaucggcaucagcggccccgacaacgaggccguggccgugcugaaguacaacggcgugaucaccgacaccaucaagagcuggagaaacaacauccugagaacccaggagagcgagugcgccugcgugaacggcagcugcuucaccgugaugaccgacggccccagcaacggccaggccagcuacaagaucuucaagaucgagaagggcaagguggugagaagcguggagcuggacgcccccaacuaccacuacgaggagugcagcugcuaccccgacgccggcgagaucaccugcgugugcagagacaacuggcacggcagcaacagacccugggugagcuucaaccagaaccuggaguaccagaccggcuacaucugcagcggcguguucggcgacagccccagacccaacgacggcaccggcagcugcggccccgugagcagcaacggcgccuucggcgugaagggcuucagcuucaaguacggcaacggcguguggaucggcagaaccaagaccaccaacagcagaagcggcuucgagaugaucugggaccccaacggcuggaccgagaccgacagcagcuucagcaugaagcaggacaucaucgccaucaccgacuggagcggcuacagcggcagcuucgugcagcaccccgagcugaccggccugaacugcaugagacccugcuucuggguggagcugaucagaggccagcccagagagaacaccaucuggaccagcggcagcagcaucagcuucugcggcgugaacagcgagaccgugggcuggagcuggcccgacggcgccgagcugcccuucaccaucgacaaguga

SEQ ID NO: 178902 - RNA, 1416 nt, Artificial Sequence
  derived and/or modified sequence opt4 from neuraminidase__InfluenzaA__EPI242204
augaaccccaaccagaagcuguucgcccugagcggcguggccaucgcccugagcgugcugaaccugcugaucggcaucagcaacgugggccugaacgugagccugcaccugaagggcgagggcgugaagcaggagaacaaccugaccugcaccaccaucacccagaacaacaccaccgugguggagaacaccuacgugaacaacaccaccaucaucaacaagggcaccaaccugaaggcccccaacuaccugcugcugaacaagagccugugcagcguggagggcuggguggugaucgccaaggacaacgccaucagauucggcgagagcgagcagaucaucgugaccagagagcccuacgugagcugcgaccccagcggcugcaagauguacgcccugcaccagggcaccaccaucagaaacaagcacagcaacggcaccauccacgacagaaccaccuucagaggccugaucagcaccccccugggcaccccccccaccgugagcaacagcgacuucaucugcgugggcuggagcagcaccagcugccacgacggcgugggcagaaugaccaucugcauccagggcaacaacgacaacgccaccgccaccguguacuacaacagaagacugaccaccaccaucaagaccugggccaagaacauccugagaacccaggagagcgagugcgugugccacaacggcaccugcgccguggugaugaccgacggccccgccagcagccaggccuacaccaagaucauguacuuccacaagggccugaucaucaaggaggagccccugagaggcagcgccagacacaucgaggagugcagcugcuacggccacgaccagaaggugagcugcgugugcagagacaacuggcagggcgccaacagacccaucaucgagaucgacaugagcacccuggagcacaccagcagauacgugugcaccggcgugcugaccgacaccagcagacccggcgacaagcccaacggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccgagaccgaccccaacagcagaaucaucgagagacaggagaucguggacaacagcaacuggagcggcuacagcggcagcuucaucgacuacugggacgaggccaacgagugcuacaaccccugcuucuacguggagcugaucagaggcagacccgaggaggccaaguacgugugguggaccagcaacagccugaucgcccugugcggcagccccgugagcgugggcagcggcagcuuccccgacggcgcccagauccaguacuucagcuga

SEQ ID NO: 178903 - RNA, 1416 nt, Artificial Sequence
  derived and/or modified sequence opt4 from neuraminidase__InfluenzaA__EPI408029
augaaccccaaccagaagcuguucgcccugagcggcguggccaucgcccugagcgugcugaaccugcugaucggcaucagcaacgugggccugaacaugagccugcaccugaagggcgagggcgugaagcaggagaacaaccugaccugcaccaccaucacccagaacaacaccaccgugguggagaacaccuacgugaacaacaccaccaucaucaacaagggcaccaaccugaaggcccccaacuaccugcugcugaacaagagccugugcagcguggagggcuggguggugaucgccaaggacaacgccaucagauucggcgagagcgagcagaucaucgugaccagagagcccuacgugagcugcgaccccagcggcugcaagauguacgcccugcaccagggcaccaccaucagaaacaagcacagcaacggcaccauccacgacagaaccaccuucagaggccugcugagcaccccccugggcaccccccccaccgugagcaacagcgacuucaucugcgugggcuggagcagcaccagcugccacgacggcgugggcagaaugaccaucugcauccagggcaacaacgacaacgccaccgccaccguguacuacaacagaagacugaccaccaccaucaagaccugggccaagaacauccugagaacccaggagagcgagugcgugugccacaacggcaccugcgccguggugaugaccgacggccccgccagcagccaggccuacaccaagaucauguacuuccacaagggccugaucaucaaggaggagccccugagaggcagcgccagacacaucgaggagugcagcugcuacggccacgaccagaaggugagcugcgugugcagagacaacuggcagggcgccaacagacccaucaucgagaucgacaugagcacccuggagcacaccagcagauacgugugcaccggcgugcugaccgacaccagcagacccggcgacaagcccaacggcgacugcagcaaccccaucaccggcagccccggcgcccccggcgugaagggcuucggcuuccugaacggcgacaacaccuggcugggcagaaccaucagccccagaagcagaagcggcuucgagaugcugaagauccccaacgccgagaccgaccccaacagcagaaucaucgagagacaggagaucguggacaacagcaacagaagcggcuacagcggcagcuucaucgacuacugggacgaggccaacgagugcuacaaccccugcuucuacguggagcugaucagaggcagacccgaggaggccaaguacgugugguggaccagcaacagccugaucgcccugugcggcagccccgugagcgugggcagcggcagcuuccccgacggcgcccagauccaguacuucagcuga

SEQ ID NO: 178904 - RNA, 1398 nt, Artificial Sequence; identical to SEQ ID NO: 175974
  derived and/or modified sequence opt4 from neuraminidase__InfluenzaA__EPI439509

SEQ ID NO: 178905 - RNA, 1350 nt, Artificial Sequence; identical to SEQ ID NO: 178507
  derived and/or modified sequence opt4 from neuraminidase__InfluenzaA__EPI164223

SEQ ID NO: 178906 - RNA, 1398 nt, Artificial Sequence; identical to SEQ ID NO: 175974
  derived and/or modified sequence opt4 from neuraminidase__InfluenzaA__EPI486493

SEQ ID NO: 178907 - RNA, 1398 nt, Artificial Sequence
  derived and/or modified sequence opt4 from neuraminidase__InfluenzaA__EPI740737
augaaccccaaccagaagauccugugcaccagcgccaccgccaucaccaucagcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagaucgaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccgugcacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggccccgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccguggugcagaucgaccccguggccaugacccacaccagccaguacaucugcagccccgugcugaccgacagccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 178908 - RNA, 1398 nt, Artificial Sequence
  derived and/or modified sequence opt4 from neuraminidase__InfluenzaA__EPI730494
augaaccccaaccagaagauccugugcaccagcgccaccgccaucaccaucggcgccaucgccgugcugaucggcaucgccaaccugggccugaacaucggccugcaccugaagcccggcugcaacugcagccacagccagcccgagaucaccaacaccagccagaccaucaucaacaacuacuacagcgagaccaacaucaccaacauccagauggaggagagaaccagcaagaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcaucaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 178909 - RNA, 1398 nt, Artificial Sequence
  derived and/or modified sequence opt4 from neuraminidase__InfluenzaA__EPI712925
augaaccccaaccagaagauccugugcaccagcgccaccgccaucaccaucggcgccaucgccgugcugaucggcaucgccaaccugggccugaacaucggccugcaccugaagcccggcugcaacugcagccacagccagcccgagaccaccaacaccagccagaccaucaucaacaacuacuacaacgagaccaacaucaccaacauccagaucgaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccgugcacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggccccgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccguggugcagaucgaccccguggccaugacccacaccagccaguacaucugcagccccgugcugaccgacagccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 178910 - RNA, 1398 nt, Artificial Sequence
  derived and/or modified sequence opt4 from neuraminidase__InfluenzaA__EPI448938
augaaccccaaccagaagauccugugcaccagcgccaccgccaucaucaucggcgccaucgccgugcugaucggcauggccaaccugggccugaacaucggccugcaccugaagcccggcugcaacugcagccacagccagcccgagaccaccaacaccagccagaccaucaucaacaacuacuacaacgagaccaacaucaccaacauccagauggaggagagaaccagcagaaacuucaacaaccugaccaagggccugugcaccaucaacagcuggcacaucuacggcaaggacaacgccgugagaaucggcgagagcagcgacgugcuggugaccagagagcccuacgugagcugcgaccccgacgagugcagauucuacgcccugagccagggcaccaccaucagaggcaagcacagcaacggcaccauccacgacagaagccaguacagagcccugaucagcuggccccugagcagcccccccaccguguacaacagcagaguggagugcaucggcuggagcagcaccagcugccacgacggcaagagcagaaugagcaucugcaucagcggccccaacaacaacgccagcgccguggugugguacaacagaagacccguggccgagaucaacaccugggccagaaacauccugagaacccaggagagcgagugcgugugccacaacggcgugugccccgugguguucaccgacggcagcgccaccggccccgccgacaccagaaucuacuacuucaaggagggcaagauccugaagugggagagccugaccggcaccgccaagcacaucgaggagugcagcugcuacggcgagagaaccggcaucaccugcaccugcagagacaacuggcagggcagcaacagacccgugauccagaucgaccccguggccaugacccacaccagccaguacaucugcagccccgugcugaccgacaaccccagacccaacgaccccaacaucggcaagugcaacgaccccuaccccggcaacaacaacaacggcgugaagggcuucagcuaccuggacggcgccaacaccuggcugggcagaaccaucagcaccgccagcagaagcggcuacgagaugcugaaggugcccaacgcccugaccgacgacagaagcaagcccauccagggccagaccaucgugcugaacgccgacuggagcggcuacagcggcagcuucauggacuacugggccgagggcgacugcuacagagccugcuucuacguggagcugaucagaggcagacccaaggaggacaaggugugguggaccagcaacagcaucgugagcaugugcagcagcaccgaguuccugggccaguggaacuggcccgacggcgccaagaucgaguacuuccuguga

SEQ ID NO: 178911 - RNA, 1410 nt, Artificial Sequence
  derived and/or modified sequence opt4 from neuraminidase__InfluenzaA__EPI445995
augaaccccaaccagaagaucaucgcccugggcagcgccagccugaccaucgccaucaucugccugcugauccagaucgccauccuggccaccaccaugacccugcacuucaugcagaacgagcacaccaacagcaccagaaacaagguggugcccugcgagagcaucaucaucgagagaaacaucaccgagaucgugcaccugaacggcaccaucaucgagaaggagagcugccccaaggccguggaguacaagaacuggagcaagccccagugccagaucaccggcuucgcccccuucagcaaggacaacagcaucagacugagcgccggcggcgacaucugggugaccagagagcccuacgugagcugcagccugagcaagugcuaccaguucgcccugggccagggcaccacccugaacaacagacacagcaacggcaccacccacgacagaagccccuacagaacccugcugaugagcgagcugggcgugcccuuccaccugggcaccaagcaggugugcaucgccuggagcagcagcagcugccacgacggcagagccuggcugcacgugugcgugaccggcgacgacaagaacgccaccgccagcgugaucuacggcggcaugcugaccgacagcaucggcagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguacaucaacguggccgacuacagcaucgacagcagcuacgugugcagcggccuggugggcgacacccccagaaacgaggacagcagcagcagcagcaacugcagagaccccaacaacgagagaggcggccccggcgugaagggcugggccuucgacaacggcgacgacguguggaugggcagaaccaucaagaaggacagcagagccggcuacgagaccuucagagugguggacggcuggacccuggccaacagcaagagccagaccaacagacaggugaucguggacagcgacaacuggagcggcuacagcggcauguucagcguggagggcaagaccugcaucaacagaugcuucuacguggagcugaucagaggcagaccccaggagaccagagugugguggaccagcaacagcaucaucguguucugcggcaccagcggcaccuacggcaccggcagcuggcccgacggcgccgacaucaacuucaugagcaucuga

SEQ ID NO: 178912 - RNA, 1410 nt, Artificial Sequence
  derived and/or modified sequence opt4 from neuraminidase__InfluenzaA__EPI470861
augaaccccaaccagaagaucaucgccaucggcagcgugagccugaccaucgccaccaucugccugcugaugcagaucgccauccuggccaccaccaugacccugcacuucaagcagaacgagugcaucaacagcagcaacaaccagguggugcccugcgagcccaucaucaucgagagaaacaucaccgagaucgugcaccugaacagcaccacccuggagaaggagaucugccccaagguggccgacuacagaaacuggagcaagccccagugccagaucaccggcuucgcccccuucagcaaggacaacagcaucagacugagcgccggcggcgacaucugggugaccagagagcccuacgugagcugcggccugggcaagugcuaccaguucgcccugggccagggcaccacccuggagaacaagcacagcaacggcaccgcccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacagaaacgccaccgccagcaucaucuacgacggcauccugguggacagcaucggcagcuggagcaagaacauccugagaacccaggagagcgagugcgugugcaucaacggcaccugcgccguggugaugaccgacggcagcgccagcggcagagccgacaccagaauccuguucaucagagagggcaagaucgcccacaucagcccccugagcggcagcgcccagcacguggaggagugcagcugcuaccccagauaccccgaggugagaugcgugugcagagacaacuggaagggcagcaacagacccgugcuguacaucaacauggccaacuacagcaucgacagcagcuacgugugcagcggccuggugggcgacacccccagaaacgacgacagaagcagcagcagcaacugcagagaccccaacaacgagagaggcgcccccggcgugaagggcugggccuucgacaacggcaacgacaucuggaugggcagaaccaucaagaaggacagcagaagcggcuacgagaccuucagagugaucggcggcuggaccaccgccaacagcaagagccagaucaacagacaggugaucguggacagcgacaacagcagcggcuacagcggcaucuucagcguggagggcaagagcugcaucaacagaugcuucuacguggagcugaucagaggcagacccaaggagaccagagugugguggaccagcaacagcaucaucguguucugcggcaccagcggcaccuacggcaccggcagcuggcccgacggcgccaacaucaacuucaugcccaucuga

SEQ ID NO: 178913 - RNA, 1401 nt, Artificial Sequence
  derived and/or modified sequence opt4 from neuraminidase__InfluenzaA__EPI498036
augaaccccaaccagaagaucaucgccaucggcagcgugagccugaucaucgccaucaucugccugcugaugcagaucgccauccugaccaccaccaugacccugcacuucagacagaacgagugcagcaaccccagcaacaaccaggugaugcccugcgagcccaucauccuggagagaaacaccgugcaccugaacagcaccaucaucgagagagagaucugccccaagguggccgacuacaagaacuggagcaagccccagugccagaucaccggcuucgcccccuucagcaaggacaacagcaucagacugagcgccggcggcgacaucugggugaccagagagcccuacgugagcugcagccuggacaagugcuaccaguucgcccugggccagggcaccacccugaagaacaagcacagcaacggcaccacccacgacagaaccccccacagaacccugcugaugaacgagcugggcgugcccuuccaccugggcaccaagcaggugugcaucgccuggagcagcagcagcugcuacgacggcaaggccuggcugcacaucugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggacagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccguguga

SEQ ID NO: 178914 - RNA, 1410 nt, Artificial Sequence
  derived and/or modified sequence opt4 from neuraminidase__InfluenzaA__EPI470902
augaaccccaaccagaagaucguggccaucggcagcgccagccugaccaucgccaccaugugccugcugaugcagaucgcccuguucgccaccaccaugacccugcacuucaagcagaccggcugcaccaacagcagcgacaaccaggccgugcccugcggccccaucaucaucgagagaaacaucaccgagaucgugcaccugaacagcaccacccuggagaaggagaccugccccaagagcgccggcuacagaaacuggagcaagccccagugccagaucaccggcuucgcccccuucagcaaggacaacagcaucagacuggccgccgccggcgacaucugggugaccagagagcccuacgugagcugcggccugggcaagugcuaccaguucgcccugggccagggcaccacccuggacaacaagcacagcaacggcaccacccacgacagaaccccccacagaacccugcugaugaacgagcugggcgugcccuuccaccuggccaccaagcaggugugcaucgccuggagcagcagcagcugccacgacggcaaggccuggcugcacgugugcgugaccggcgacgacaagaacgccaccgccagcaucaucuacgacggcauccugguggacagcaucgccagcuggagcaagaacauccugagaacccaggagagcgagugcgugugcaucaacggcaccugcaccguggugaugaccgacggcagcgccagcggcagagccgacaccagaauccuguucaucagagagggcaagaucgugcacaucagcccccugagcggcagcgcccagcacguggaggagugcagcugcuaccccagauaccccgaggugagaugcgugugcagagacaacuggaagggcagcaacagacccgugcuguucaucaacauggccgacuacagcaucgacagcagcuacgugugcagcggccuggugggcgacacccccagaaacgacgacagaagcagcagcagcaacugcagagaccccaacaacgagagaggcgcccccggcgugaagggcugggccuucgacagcggcaacgacaucuggaugggcagaaccaucgagaaggacagcagaagcggcuacgagaccuucagagugaucggcggcuggagcaccgccaacagcaagagccagaucaacagacaggugaucguggacagagacaacagcagcggcuacagcggcaucuucagcguggagggcaagagcugcaucaacagaugcuucuacguggagcugaucagaggcagacccaaggagaacagagugugguggaccagcaacagcaucaucguguucugcggcaccagcggcaccuacggcaccggcagcuggcccgacggcgccaacaucaaccugaugcccaucuga

SEQ ID NO: 178915 - RNA, 1401 nt, Artificial Sequence
  derived and/or modified sequence opt4 from neuraminidase__InfluenzaA__EPI838241
augaaccccaaccagaagaucaccgccaucggcagcgugagccugaucaucgccaucaucugccugcugaugcagaucgccauccugaccaccaccaugacccugcacuucagacagaacgagugcagcaacagcagcaacaaccaggugaugcccugcgagcccaucaucaucgagagaaacaccgugcaccugaacagcaccaccaucgagagagagaucugccccaagguggccgaguacaagaacuggagcaagccccagugccagaucaccggcuucgcccccuucagcaaggacaacagcaucagacugagcgccagcggcgacaucugggugaccagagagcccuacgugagcugcagccuggacaagugcuaccaguucgcccugggccagggcaccacccugaagaacaagcacagcaacggcaccgcccacgacagaaccccccacagaacccugcugaugaacgagcugggcgugcccuuccaccugggcaccaagcaggugugcaucgccuggagcagcagcagcugcuacgacggcaaggccuggcugcacgugugcgugaccggcgacgacaagaacgccaccgccagcaucaucuacgacggcaugcugguggacagcaucggcagcuggagcaagaacauccugagaacccaggagagcgagugcgugugcaucaacggcaccugcgccguggugaugaccgacggcagcgccagcggcaaggccgacaccagagugcuguucaucagagagggcaagaucaucaacaucagcccccugagcggcagcgcccagcacguggaggagugcagcugcuaccccagauaccccgaggugagaugcgugugcagagacaacuggaagggcagcaacagacccauccuguacaucaacauggccgacuacagcaucgagagcagcuacgugugcagcggccuggugggcgacacccccagaaacgacgacagcagcagcagcagcaacugcagagaccccaacaacgagagaggcgcccccggcgugaagggcugggccuucgacgacggcaacgacguguggaugggcagaaccaucaagaacggcagcagaagcggcuacgagaccuucagaguggugaacggcuggaccauggccaacagcaagagccagaucaacagacaggugaucguggagagcgacgacuggagcggcuacagcggcaucuucagcguggagggcaagaagugcaucaacagaugcuucuacguggagcugaucagaggcagaccccaggagcccagagugugguggaccagcaacagcaucaucguguucugcggcaccagcggcaccuacggcaccggcagcuggcccgacggcgccaacaucaacuucaugcccaucuga

SEQ ID NO: 178916 - RNA, 1401 nt, Artificial Sequence; identical to SEQ ID NO: 178915
  derived and/or modified sequence opt4 from neuraminidase__InfluenzaA__EPI680525

SEQ ID NO: 178917 - RNA, 1401 nt, Artificial Sequence; identical to SEQ ID NO: 178523
  derived and/or modified sequence opt4 from neuraminidase__InfluenzaA__EPI690481

SEQ ID NO: 178918 - RNA, 1755 nt, Artificial Sequence
  derived and/or modified sequence opt4 from hemagglutinin__InfluenzaB__ABL76276
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178919 - RNA, 1755 nt, Artificial Sequence
  derived and/or modified sequence opt4 from hemagglutinin__InfluenzaB__ABL76287
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccaucgaggugccccacaucugcaccaaggaggaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178920 - RNA, 1755 nt, Artificial Sequence
  derived and/or modified sequence opt4 from hemagglutinin__InfluenzaB__ABL76298
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178921 - RNA, 1755 nt, Artificial Sequence
  derived and/or modified sequence opt4 from hemagglutinin__InfluenzaB__ABL76309
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagagacccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccgaggaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178922 - RNA, 1755 nt, Artificial Sequence
  derived and/or modified sequence opt4 from hemagglutinin__InfluenzaB__ABL76331
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccaucgaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178923 - RNA, 1755 nt, Artificial Sequence
  derived and/or modified sequence opt4 from hemagglutinin__InfluenzaB__ABL76342
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcgacuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucagaggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgacuucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178924 - RNA, 1755 nt, Artificial Sequence
  derived and/or modified sequence opt4 from hemagglutinin__InfluenzaB__ABL76353
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucagaggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgacuucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178925 - RNA, 1755 nt, Artificial Sequence
  derived and/or modified sequence opt4 from hemagglutinin__InfluenzaB__ABL76375
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178926 - RNA, 1755 nt, Artificial Sequence; identical to SEQ ID NO: 178925
  derived and/or modified sequence opt4 from hemagglutinin__InfluenzaB__ABL76386

SEQ ID NO: 178927 - RNA, 1755 nt, Artificial Sequence
  derived and/or modified sequence opt4 from hemagglutinin__InfluenzaB__ABL76408
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugcuucaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagaggcaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178928 - RNA, 1755 nt, Artificial Sequence
  derived and/or modified sequence opt4 from hemagglutinin__InfluenzaB__ABL76419
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugcuucaacugcaccgaccuggacguggcccugggcagacccaugugcgugggcaucacccccagcgccaaggccagcauccugcacgagaucagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagaggcaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178929 - RNA, 1758 nt, Artificial Sequence
  derived and/or modified sequence opt4 from hemagglutinin__InfluenzaB__ABL76441
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagcccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacgagcuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178930 - RNA, 1758 nt, Artificial Sequence
  derived and/or modified sequence opt4 from hemagglutinin__InfluenzaB__ABL76463
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaaggugaacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178931 - RNA, 1758 nt, Artificial Sequence
  derived and/or modified sequence opt4 from hemagglutinin__InfluenzaB__ABL76474
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacgagcuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178932 - RNA, 1758 nt, Artificial Sequence
  derived and/or modified sequence opt4 from hemagglutinin__InfluenzaB__ABL76485
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgugaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgagaacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178933 - RNA, 1758 nt, Artificial Sequence
  derived and/or modified sequence opt4 from hemagglutinin__InfluenzaB__ABL76507
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178934 - RNA, 1758 nt, Artificial Sequence
  derived and/or modified sequence opt4 from hemagglutinin__InfluenzaB__ABL76518
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagaaccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178935 - RNA, 1758 nt, Artificial Sequence
  derived and/or modified sequence opt4 from hemagglutinin__InfluenzaB__ABL76529
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgugaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178936 - RNA, 1758 nt, Artificial Sequence
  derived and/or modified sequence opt4 from hemagglutinin__InfluenzaB__ABL76540
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugaagcccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178937 - RNA, 1758 nt, Artificial Sequence
  derived and/or modified sequence opt4 from hemagglutinin__InfluenzaB__ABL76551
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugauggccaucuucgugguguacauggugagcagagacaacgugagcugcagcaucugccuguga

SEQ ID NO: 178938 - RNA, 1758 nt, Artificial Sequence
  derived and/or modified sequence opt4 from hemagglutinin__InfluenzaB__ABL76562
augaaggccaucaucgugcugcugaugguggugaccagcaacgccgacagaaucugcaccagaaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgugggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178939 - RNA, 1758 nt, Artificial Sequence
  derived and/or modified sequence opt4 from hemagglutinin__InfluenzaB__ABL76573
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178940 - RNA, 1758 nt, Artificial Sequence; identical to SEQ ID NO: 178939
  derived and/or modified sequence opt4 from hemagglutinin__InfluenzaB__ABL76584

SEQ ID NO: 178941 - RNA, 1758 nt, Artificial Sequence; identical to SEQ ID NO: 178939
  derived and/or modified sequence opt4 from hemagglutinin__InfluenzaB__ABL76595

SEQ ID NO: 178942 - RNA, 1758 nt, Artificial Sequence; identical to SEQ ID NO: 178939
  derived and/or modified sequence opt4 from hemagglutinin__InfluenzaB__ABL76606

SEQ ID NO: 178943 - RNA, 1758 nt, Artificial Sequence
  derived and/or modified sequence opt4 from hemagglutinin__InfluenzaB__ABL76617
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178944 - RNA, 1755 nt, Artificial Sequence
  derived and/or modified sequence opt4 from hemagglutinin__InfluenzaB__ABL76628
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugccccacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178945 - RNA, 1755 nt, Artificial Sequence
  derived and/or modified sequence opt4 from hemagglutinin__InfluenzaB__ABL76639
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaaggccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178946 - RNA, 1755 nt, Artificial Sequence
  derived and/or modified sequence opt4 from hemagglutinin__InfluenzaB__ABL76683
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178947 - RNA, 1752 nt, Artificial Sequence
  derived and/or modified sequence opt4 from hemagglutinin__InfluenzaB__ABL76694
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagagagcccccggcggccccuacagacugggcaccagcggcagcugccccaacgugaccagcagagacggcuucuucgccaccauggccugggccgugcccagagacaacaagaccgccaccaacccccugaccguggaggugcccuacaucugcaccaagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178948 - RNA, 1758 nt, Artificial Sequence
  derived and/or modified sequence opt4 from hemagglutinin__InfluenzaB__ABL76716
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccgagaccagaggcaagcugugccccaagugccugaacugcaccgaccuggacguggcccugggcagacccaagugcaccggcaacauccccagcgccagagugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaacgcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggugaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178949 - RNA, 1755 nt, Artificial Sequence
  derived and/or modified sequence opt4 from hemagglutinin__InfluenzaB__ABL76760
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccaucgaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178950 - RNA, 1755 nt, Artificial Sequence
  derived and/or modified sequence opt4 from hemagglutinin__InfluenzaB__ABL76771
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccaucgaggugccccacaucugcaccaaggaggaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagauccugggccccagcgccguggacaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178951 - RNA, 1755 nt, Artificial Sequence
  derived and/or modified sequence opt4 from hemagglutinin__InfluenzaB__ABL76782
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagccccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacaucgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaaggcccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178952 - RNA, 1755 nt, Artificial Sequence; identical to SEQ ID NO: 178925
  derived and/or modified sequence opt4 from hemagglutinin__InfluenzaB__ABL76793

SEQ ID NO: 178953 - RNA, 1755 nt, Artificial Sequence; identical to SEQ ID NO: 178925
  derived and/or modified sequence opt4 from hemagglutinin__InfluenzaB__ABL76815

SEQ ID NO: 178954 - RNA, 1758 nt, Artificial Sequence
  derived and/or modified sequence opt4 from hemagglutinin__InfluenzaB__ABL76826
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccgagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178955 - RNA, 1758 nt, Artificial Sequence
  derived and/or modified sequence opt4 from hemagglutinin__InfluenzaB__ABL76837
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaaggugagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccguggaggugcccuacaucugcaccgagggcgaggaccagaucaccguguggggcuuccacagcgacagcgagacccagauggccaagcuguacggcgacagcaagccccagaaguucaccagcagcagcaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagagauacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178956 - RNA, 1755 nt, Artificial Sequence
  derived and/or modified sequence opt4 from hemagglutinin__InfluenzaB__ABL76848
augaaggccaucaucgugcugcugaugguggugaccagcaacgccgacagaaucugcaccggcaucaccagcagcaacagcagccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucaccccccccgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178957 - RNA, 1755 nt, Artificial Sequence; identical to SEQ ID NO: 178925
  derived and/or modified sequence opt4 from hemagglutinin__InfluenzaB__ABL76859

SEQ ID NO: 178958 - RNA, 1755 nt, Artificial Sequence
  derived and/or modified sequence opt4 from hemagglutinin__InfluenzaB__ABL76881
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggccagcggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacgagacccagaugaagaaccuguacggcgacagcaacccccagaaguucaccagcagcgccaacggcgugaccacccacuacgugagccagaucggcggcuuccccgaccagaaggaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178959 - RNA, 1755 nt, Artificial Sequence
  derived and/or modified sequence opt4 from hemagglutinin__InfluenzaB__ABL76892
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178960 - RNA, 1755 nt, Artificial Sequence
  derived and/or modified sequence opt4 from hemagglutinin__InfluenzaB__ABL76903
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagagcgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugauccagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcgcccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178961 - RNA, 1758 nt, Artificial Sequence
  derived and/or modified sequence opt4 from hemagglutinin__InfluenzaB__ABL76914
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcagcaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagagauacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178962 - RNA, 1755 nt, Artificial Sequence
  derived and/or modified sequence opt4 from hemagglutinin__InfluenzaB__ABL76936
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178963 - RNA, 1755 nt, Artificial Sequence
  derived and/or modified sequence opt4 from hemagglutinin__InfluenzaB__ABL76947
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacgacaagacccagaugaagaaccuguacggcgacagcaacccccagaaguucaccagcagcaccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178964 - RNA, 1758 nt, Artificial Sequence
  derived and/or modified sequence opt4 from hemagglutinin__InfluenzaB__ABL76958
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacaucagcugcagcaucugccuguga

SEQ ID NO: 178965 - RNA, 1758 nt, Artificial Sequence
  derived and/or modified sequence opt4 from hemagglutinin__InfluenzaB__ABL76969
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccagaaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcauccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178966 - RNA, 1755 nt, Artificial Sequence
  derived and/or modified sequence opt4 from hemagglutinin__InfluenzaB__ABL76980
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcgacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178967 - RNA, 1752 nt, Artificial Sequence
  derived and/or modified sequence opt4 from hemagglutinin__InfluenzaB__ABL76991
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaucacccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaacaagauccagaugaagaaccuguacggcgacagcaacccccagaaguucaccagcagcgccaacggcaucaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagaagggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178968 - RNA, 1755 nt, Artificial Sequence
  derived and/or modified sequence opt4 from hemagglutinin__InfluenzaB__ABL77002
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccaucgaggugccccacaucugcaccaaggaggaggaccagaucaccaucuggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178969 - RNA, 1755 nt, Artificial Sequence
  derived and/or modified sequence opt4 from hemagglutinin__InfluenzaB__ABL77013
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagaaccagaugaagaaccuguacggcgacagcgacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178970 - RNA, 1755 nt, Artificial Sequence
  derived and/or modified sequence opt4 from hemagglutinin__InfluenzaB__ABL77024
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacgacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178971 - RNA, 1755 nt, Artificial Sequence
  derived and/or modified sequence opt4 from hemagglutinin__InfluenzaB__ABL77035
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178972 - RNA, 1755 nt, Artificial Sequence
  derived and/or modified sequence opt4 from hemagglutinin__InfluenzaB__ABL77046
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacgacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccaucgacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178973 - RNA, 1755 nt, Artificial Sequence
  derived and/or modified sequence opt4 from hemagglutinin__InfluenzaB__ABL77057
augaaggccaucaucgugcugcugaugguggugaccagcaaggccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugaagcccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagccccagaugaagaaccuguacggcgacagcaacccccagaaguucaccagcagcgccaacggcaucaccacccacuacgugagccagaucggcggcuuccccgagcagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178974 - RNA, 1758 nt, Artificial Sequence
  derived and/or modified sequence opt4 from hemagglutinin__InfluenzaB__ABL77068
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacaacgagaaccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178975 - RNA, 1758 nt, Artificial Sequence
  derived and/or modified sequence opt4 from hemagglutinin__InfluenzaB__ABL77090
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccugaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacaacgagauccagauggugaagcuguacggcgacagcaagccccagaaguucaccagcagcgccaacggcgugaccacccacuacgugagccagaucggcggcuuccccaaccagaucgaggacggcggccugccccagagcggcagaaucgugguggacuacauggugcagaagagcggcaagaccggcaccaucaccuaccagagaggcauccugcugccccagaagguguggugcgccagcggcagaagcaagaucaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178976 - RNA, 1755 nt, Artificial Sequence
  derived and/or modified sequence opt4 from hemagglutinin__InfluenzaB__ABL77101
augaaggccaucaucgugcugcugaugguggugaccagcaaggccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugaagcccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacgacaagacccagaugaagaaccuguacggcgacagcaacccccagaaguucaccagcagcgccaacggcaucaccacccacuacgugagccagaucggcggcuuccccgagcagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178977 - RNA, 1758 nt, Artificial Sequence
  derived and/or modified sequence opt4 from hemagglutinin__InfluenzaB__ABL77134
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacgccaccgccgccagcagccuggccgugacccugaugaucgccaucuucgugguguacauggugagcagagacaacgugagcugcagcaucugccuguga

SEQ ID NO: 178978 - RNA, 1758 nt, Artificial Sequence
  derived and/or modified sequence opt4 from hemagglutinin__InfluenzaB__ABL77145
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgaggaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178979 - RNA, 1755 nt, Artificial Sequence
  derived and/or modified sequence opt4 from hemagglutinin__InfluenzaB__ABL77156
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178980 - RNA, 1758 nt, Artificial Sequence
  derived and/or modified sequence opt4 from hemagglutinin__InfluenzaB__ABL77178
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacagcgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178981 - RNA, 1755 nt, Artificial Sequence
  derived and/or modified sequence opt4 from hemagglutinin__InfluenzaB__ABL77189
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcauccccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178982 - RNA, 1758 nt, Artificial Sequence
  derived and/or modified sequence opt4 from hemagglutinin__InfluenzaB__ABL77200
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaugggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaaggccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacggcaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178983 - RNA, 1755 nt, Artificial Sequence
  derived and/or modified sequence opt4 from hemagglutinin__InfluenzaB__ABL77222
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcuggccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacagcaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 178984 - RNA, 1758 nt, Artificial Sequence
  derived and/or modified sequence opt4 from hemagglutinin__InfluenzaB__ABL77233
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcagaaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 178985 - RNA, 1758 nt, Artificial Sequence
  derived and/or modified sequence opt4 from hemagglutinin__InfluenzaB__ABL77244
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaccauccccagcgccaaggccagcauccugcacgaggugaagcccgugaccagcggcugcuuccccaucaugcacgacagaaccaagaucagacagcugcccaaccugcugagaggcuacgagcacaucagacugagcacccacaacgugaucaacgccgagaccgcccccggcggccccuacaaggugggcaccagcggcagcugccccaacgugaccaacggcaacggcuucuucgccaccauggccugggccgugcccaagaacgacaacaacaagaccgccaccaacccccugaccguggaggugcccuacaucugcaccgagggcgaggaccagaucaccguguggggcuuccacagcgacaacgaggcccagauggugaagcuguacggcgacagcaagccccagaaguucaccagcagcgccaacggcgugaccacccacuacgugagccagaucggcggcuuccccaaccaggccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagaagggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacaagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178986 - RNA, 1752 nt, Artificial Sequence
  derived and/or modified sequence opt4 from hemagglutinin__InfluenzaB__ABL77255
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaugggcaccauccccagcgccaaggccagcauccugcacgaggugagacccgugaccagcggcugcuuccccaucaugcacgacagaaccaagaucagacagcugcccaaccugcugagaggcuacgagaacaucagacugagcacccacaacgugaucaacgccgagagagcccccggcggccccuacagacugggcaccagcggcagcugccccaacgugaccagcagaaacggcuucuucgccaccauggccugggccgugcccagagacaacaagaccgccaccaacccccugaccguggaggugcccuacaucugcaccaagggcgaggaccagaucaccguguggggcuuccacagcgacgacaagacccagaugaagaaccuguacggcgacagcaacccccagaaguucaccagcagcgccaacggcgugaccacccacuacgugagccagaucggcgacuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178987 - RNA, 1752 nt, Artificial Sequence
  derived and/or modified sequence opt4 from hemagglutinin__InfluenzaB__ABL77266
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagagagcccccggcggccccuacagacugggcaccagcggcagcugccccaacgugaccagcagagacggcuucuucgccaccauggccugggccgugcccagagacaacaagaccgccaccaacccccugaccguggaggugcccuacaucugcaccaagggcgaggaccagaucaccguguggggcuuccacagcgacagcaagacccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178988 - RNA, 1752 nt, Artificial Sequence
  derived and/or modified sequence opt4 from hemagglutinin__InfluenzaB__ABL77277
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaacacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagagagcccccggcggccccuacagacugggcaccagcggcagcugccccaacgugaccaacagagacggcuucuucgccaccauggccugggccgugcccagagacaacaagaccgccaccaacccccugaccguggaggugcccuacaucugcaccaagggcgaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178989 - RNA, 1752 nt, Artificial Sequence
  derived and/or modified sequence opt4 from hemagglutinin__InfluenzaB__ABL77288
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagcacaucagacugagcacccagaacgugaucaacgccgagaaggcccccggcggccccuacaagcugggcaccagcggcagcugccccaacgccaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaccaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178990 - RNA, 1752 nt, Artificial Sequence
  derived and/or modified sequence opt4 from hemagglutinin__InfluenzaB__ABL77299
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaacauccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaacgagacccagaugaagaaccuguacggcgacagcaacccccagaaguucaccagcagcgccaacggcaucaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178991 - RNA, 1752 nt, Artificial Sequence
  derived and/or modified sequence opt4 from hemagglutinin__InfluenzaB__ABL77310
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaccauccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaacaagaaccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgugagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178992 - RNA, 1758 nt, Artificial Sequence
  derived and/or modified sequence opt4 from hemagglutinin__InfluenzaB__ABL77321
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaccauccccagcgccaaggugagcauccugcacgaggugaagcccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacaucaccaacggcaacggcuucuucgccaccauggccugggccgugcccaagaacgacaacaacaagaccgccaccaacagccugaccguggaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccaggccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaaccuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178993 - RNA, 1755 nt, Artificial Sequence
  derived and/or modified sequence opt4 from hemagglutinin__InfluenzaB__ABL77332
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacaagcugggcaccagcggcagcugccccaacgccaccagcagaagcggcuucuucgccaccauggccugggccgugcccagagacaacaacaagaccgccaccaacccccugaccguggaggugcccuacaucugcaccaagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacgccauccugcuguacuacagcaccgccgccagcagccuggccgugacccugaugaucgccaucuucaucguguacauggugagcagagacaacgugagcugcagcaucugccuguga

SEQ ID NO: 178994 - RNA, 1755 nt, Artificial Sequence
  derived and/or modified sequence opt4 from hemagglutinin__InfluenzaB__ABL77343
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaagggcgaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaagguggugaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178995 - RNA, 1755 nt, Artificial Sequence
  derived and/or modified sequence opt4 from hemagglutinin__InfluenzaB__ABL77365
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccaggccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 178996 - RNA, 1755 nt, Artificial Sequence
  derived and/or modified sequence opt4 from hemagglutinin__InfluenzaB__ABL84340
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacaccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacggcgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 178997 - RNA, 1755 nt, Artificial Sequence; identical to SEQ ID NO: 178918
  derived and/or modified sequence opt4 from hemagglutinin__InfluenzaB__ABN50382

SEQ ID NO: 178998 - RNA, 1755 nt, Artificial Sequence; identical to SEQ ID NO: 178918
  derived and/or modified sequence opt4 from hemagglutinin__InfluenzaB__ABN50393

SEQ ID NO: 178999 - RNA, 1755 nt, Artificial Sequence
  derived and/or modified sequence opt4 from hemagglutinin__InfluenzaB__ABN50404
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179000 - RNA, 1755 nt, Artificial Sequence; identical to SEQ ID NO: 178927
  derived and/or modified sequence opt4 from hemagglutinin__InfluenzaB__ABN50415

SEQ ID NO: 179001 - RNA, 1755 nt, Artificial Sequence; identical to SEQ ID NO: 178927
  derived and/or modified sequence opt4 from hemagglutinin__InfluenzaB__ABN50426

SEQ ID NO: 179002 - RNA, 1755 nt, Artificial Sequence
  derived and/or modified sequence opt4 from hemagglutinin__InfluenzaB__ABN50437
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacaucugcaccgagggcgaggaccagaucaccguguggggcuuccacagcgacaacaagacccagaugaagaaccuguacggcgaccccaacccccagaaguucaccagcagcgccaacggcgugaccacccacuacgugagccagaucggcggcuuccccgaccagaccgaggacggcggccugccccagagcggcagaaucgugguggacuacaugaugcagaagcccggcaagaccggcaccaucguguaccagagaggcgugcugcugccccagaagguguggugcgccagcggcaagagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179003 - RNA, 1758 nt, Artificial Sequence
  derived and/or modified sequence opt4 from hemagglutinin__InfluenzaB__ABN50459
augaaggcccugaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccgaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccaucuggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179004 - RNA, 1758 nt, Artificial Sequence
  derived and/or modified sequence opt4 from hemagglutinin__InfluenzaB__ABN50470
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179005 - RNA, 1755 nt, Artificial Sequence
  derived and/or modified sequence opt4 from hemagglutinin__InfluenzaB__ABN50481
augaaggccaucaucgugcugcugcugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugcuucaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucgacgccgagaaggcccccggcggccccuacagacugggcaccagcggcagcugccccaacgccaccagcaagagcggcuucuucgccaccauggccugggccgugcccagagacaacaacaagaccgccaccaacccccugaccguggaggugccccacaucugcaccaaggaggaggaccagaucaccguguggggcuuccacagcgacaacaagacccagaugaagaaccuguacggcgacagcaacccccagaaguucaccagcagcgccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179006 - RNA, 1755 nt, Artificial Sequence
  derived and/or modified sequence opt4 from hemagglutinin__InfluenzaB__ABN50503
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaccugccugaacugcaccgaccuggacguggcccugggcagacccaugugcgugggcgugacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccaaggacaacaacaagaccgccaccaacccccugaccguggaggugccccacaucugcaccaaggaggaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179007 - RNA, 1755 nt, Artificial Sequence
  derived and/or modified sequence opt4 from hemagglutinin__InfluenzaB__ABN50514
augaaggccaucaucgugcugcugaugguggccaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucgccaccauggccugggccgugcccaaggacaacaacaagaacgccaccaacccccugaccguggaggugcccuacgugugcaccgagggcgaggaccagaucaccguguggggcuuccacagcgacaacaagccccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacgacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179008 - RNA, 1755 nt, Artificial Sequence
  derived and/or modified sequence opt4 from hemagglutinin__InfluenzaB__ABN50525
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagcuacuucgccaaccugaagggcaccagaaccagaggcaagcugugccccgacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucgacgccgagaaggcccccggcggccccuacagacugggcaccagcggcagcugccccaacgccaccagcaagagcggcuucuucagcaccauggccugggccgugcccaaggacaacaacaagaacgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugcuggccaucuucaucguguacauggugagcagagacaacgugagcugcagcaucugccuguga

SEQ ID NO: 179009 - RNA, 1758 nt, Artificial Sequence
  derived and/or modified sequence opt4 from hemagglutinin__InfluenzaB__ABN50536
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgaggaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacaacgagauccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179010 - RNA, 1758 nt, Artificial Sequence
  derived and/or modified sequence opt4 from hemagglutinin__InfluenzaB__ABN50547
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagcugaccguguggggcuuccacagcgacaacgagaaccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179011 - RNA, 1758 nt, Artificial Sequence
  derived and/or modified sequence opt4 from hemagglutinin__InfluenzaB__ABN50558
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaaggagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacaugaugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucgacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179012 - RNA, 1755 nt, Artificial Sequence; identical to SEQ ID NO: 178927
  derived and/or modified sequence opt4 from hemagglutinin__InfluenzaB__ABN50569

SEQ ID NO: 179013 - RNA, 1758 nt, Artificial Sequence; identical to SEQ ID NO: 178939
  derived and/or modified sequence opt4 from hemagglutinin__InfluenzaB__ABN50580

SEQ ID NO: 179014 - RNA, 1758 nt, Artificial Sequence
  derived and/or modified sequence opt4 from hemagglutinin__InfluenzaB__ABN50591
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagagaaucagacugagcaaccacaacgugaucaacgccgagaaggcccccggcggccccuacaagaucggcaccagcggcagcugccccaacgugaccaacggcaacggcuucuucgccaccauggccugggccgugcccaagaacgagaacaacaagaccgccaccaacagccugaccaucgaggugcccuacaucugcaccgagggcgaggaccagaucaccguguggggcuuccacagcgacaacgaggcccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179015 - RNA, 1758 nt, Artificial Sequence
  derived and/or modified sequence opt4 from hemagglutinin__InfluenzaB__ABN50602
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaugggcaccauccccagcgccaaggccagcauccugcacgaggugaagcccgugaccagcggcugcuuccccaucaugcacgacagaaccaagaucagacagcugcccaaccugcugagaggcuacgagaacaucagacugagcacccacaacgugaucaacgccgagaccgcccccggcggccccuacaagaucggcaccagcggcagcugccccaacaucaccaacggcaacggcuucuucgccaccauggccugggccgugcccaagaacgacaacaacaagaccgccaccaacccccugaccguggaggugcccuacaucugcaccgagggcgaggaccagaucaccguguggggcuuccacagcgacaacgagacccagauggugaagcuguacggcgacagcaagccccagaaguucaccagcagcgccaacggcgugaccgcccacuacgugagccagaucggcggcuuccccaaccaggccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179016 - RNA, 1752 nt, Artificial Sequence
  derived and/or modified sequence opt4 from hemagglutinin__InfluenzaB__ABN50624
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaccauccccagcgccaaggccagcauccugcacgaggugagacccgugaccagcggcugcuuccccaucaugcacgacagaaccaagaucagacagcugcccaaccugcugagaggcuacgagaacaucagacugagcacccacaacgugaucaacgccgagagagcccccggcggccccuacagacugggcaccagcggcagcugccccaacgugaccagcaagagcggcuucuucgccaccauggccugggccgugcccagagacaacaagaccgccaccaacccccugaccguggaggugcccuacaucugcaccaagggcgaggaccagaucaccguguggggcuuccacagcgacaacaagaaccagaugaagaaccuguacggcgacagcaacccccagaaguucaccagcagcgugaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179017 - RNA, 1752 nt, Artificial Sequence
  derived and/or modified sequence opt4 from hemagglutinin__InfluenzaB__ABN50635
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaccauccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacagcaagacccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179018 - RNA, 1752 nt, Artificial Sequence
  derived and/or modified sequence opt4 from hemagglutinin__InfluenzaB__ABN50646
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaccauccccagcgccaaggccagcauccugcacgaggugagacccgugaccagcggcugcuuccccaucaugcacgacagaaccaagaucagacagcugcccaaccugcugagaggcuacgagcacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacagcgacaacaagaaccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179019 - RNA, 1752 nt, Artificial Sequence
  derived and/or modified sequence opt4 from hemagglutinin__InfluenzaB__ABN50657
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacagacugggcaccagcggcagcugccccaacgugaccagcagaaccggcuucuucgccaccauggccugggccgugcccagagacaacaagaccgccaccaacccccugaccguggaggugcccuacaucugcaccaagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179020 - RNA, 1755 nt, Artificial Sequence
  derived and/or modified sequence opt4 from hemagglutinin__InfluenzaB__ABN50679
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaagggcgaggaccagaucaccguguggggcuuccacagcgacgacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179021 - RNA, 1755 nt, Artificial Sequence
  derived and/or modified sequence opt4 from hemagglutinin__InfluenzaB__ABN50690
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacgugugcaccgagggcgaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179022 - RNA, 1752 nt, Artificial Sequence
  derived and/or modified sequence opt4 from hemagglutinin__InfluenzaB__ABN50701
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaacaucagacugagcacccagaacgugaucaacgccgagaaggcccccggcggccccuacagacugggcaccagcggcagcugccccaacgugaccagcagaaccggcuucuucgccaccauggccugggccgugcccagagacaacaagaccgccaccaacccccugaccguggaggugcccuacaucugcaccaagggcgaggaccagaucaccguguggggcuuccacagcgacaacaaggcccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179023 - RNA, 1755 nt, Artificial Sequence; identical to SEQ ID NO: 179021
  derived and/or modified sequence opt4 from hemagglutinin__InfluenzaB__ABN50712

SEQ ID NO: 179024 - RNA, 1755 nt, Artificial Sequence
  derived and/or modified sequence opt4 from hemagglutinin__InfluenzaB__ABN50723
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugagaggcaccaagaccagaggcaagcugugccccaccugccugaacugcaccgaccuggacguggcccugggcagacccaugugcgugggcaccacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucgccaccauggccugggccgugcccagagacaacaacaagaccgccaccaacccccugaccguggaggugcccuacaucugcaccaaggaggaggaccagaucaccguguggggcuuccacagcgacaacaagacccagaugaagaaccuguacggcgacagcaacccccagaaguucaccagcagcgccaacggcgugaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179025 - RNA, 1755 nt, Artificial Sequence
  derived and/or modified sequence opt4 from hemagglutinin__InfluenzaB__ABN50734
augaaggccaucaucgugcugcugaugguggugaccagcaacgccgacagaaucugcaccggcaucaccagcagcaacagcccccacguggugaagaccgccacccagggcgaggugaacgugaccggcgccaucccccugaccaccacccccaccaagagccacuucgccaaccugaagggcaccaagaccagaggcaagcugugccccaccugccugaacugcaccgaccuggacguggcccugggcagacccaugugcgugggcaucacccccagcgccaaggccagcauccugcacgaggugagacccgugaccagcggcugcuuccccaucaugcacgacagaaccaagaucagacagcugcccaaccugcugagaggcuacgagaagaucagacugagcacccagaacgugaucaacgccgagaaggcccccggcggccccuacagacugggcaccagcggcagcugccccaacgccaccagcagaagcggcuucuucaccaccauggccugggccgugcccagagacaacaacaagaccgccaccaacccccugaccguggaggugccccacaucugcaccaaggaggaggaccagaucaccguguggggcuuccacagcgacgacaagacccagaugaagaaccuguacggcgacagcaacccccagaaguucaccagcagcaccaacggcaucaccacccacuacgugagccagaucggcggcuuccccgaccagaccgaggacggcggccugccccagagcggcagaaucgugguggacuacauggugcagaagcccggcaagaccggcaccaucguguaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacaugaucagcagagacaacgugagcugcagcaucugccuguga

SEQ ID NO: 179026 - RNA, 1758 nt, Artificial Sequence
  derived and/or modified sequence opt4 from hemagglutinin__InfluenzaB__ABN50745
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaacauccccagcgccaaggugagcauccugcacgaggugagacccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacaucaccaacggcaacggcuucuucgccaccauggccugggccgugcccaagaacgacaacaacaagaccgccaccaacagccugaccaucgaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccagaccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucgugguguacauggugagcagagacaacgugagcugcagcaucugccuguga

SEQ ID NO: 179027 - RNA, 1752 nt, Artificial Sequence
  derived and/or modified sequence opt4 from hemagglutinin__InfluenzaB__ABN51184
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaccauccccagcgccaaggccagcauccugcacgaggugagacccgugaccagcggcugcuuccccaucaugcacgacagaaccaagaucagacagcugcccaaccugcugagaggcuacgagaacaucagacugagcacccacaacgugaucaacgccgagagagcccccggcggccccuacagacugggcaccagcggcagcugccccaacgugaccagcaagagcggcuucuucgccaccauggccugggccgugcccagagacaacaagaccgccaccaacccccugaccguggaggugcccuacaucugcaccaagggcgaggaccagaucaccguguggggcuuccacagcgacaacaagauccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179028 - RNA, 1752 nt, Artificial Sequence
  derived and/or modified sequence opt4 from hemagglutinin__InfluenzaB__ABN51195
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaacugccugaacugcaccgaccuggacguggcccugggcagacccaugugcaucggcaccauccccagcgccaaggccagcauccugcacgaggugagacccgugaccagcggcugcuuccccaucaugcacgacagaaccaagaucagacagcugcccaaccugcugagaggcuacgagaacaucagacugagcacccacaacgugaucaacgccgagagagcccccggcggccccuacagacugggcaccagcggcagcugccccaacgugaccagcagaagcggcuucuucgccaccauggccugggccgugcccagagacaacaagaccgccaccaacccccugaccguggaggugcccuacaucugcaccaagggcgaggaccagaucaccguguggggcuuccacuucgacaacaagauccagaugaagaaccuguacggcgacagcaacccccagaaguucaccagcagcgccaacggcgugaccacccacuacgugagccagaucggcggcuuccccaaccagaccgaggacggcggccugccccagagcggcagaaucgugguggacuacauggugcagaagcccggcaagaccggcaccaucguguaccagagaggcgugcugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggacaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179029 - RNA, 1758 nt, Artificial Sequence
  derived and/or modified sequence opt4 from hemagglutinin__InfluenzaB__ABN58661
augaaggccaucaucgugcugcugaugguggugaccagcaacgccgacagaaucugcaccggcaucaccagcagcaacagcccccacguggugaagaccgccacccagggcgaggugaacgugaccggcgugaucccccugaccaccacccccaccaagagccacuucgccaaccugaagggcaccaagaccagaggcaagcugugccccaagugccugaacugcaccgaccuggacguggcccugggcagacccaagugcaccggcaccauccccagcgccaaggugagcauccugcacgaggugaagcccgugaccagcggcugcuuccccaucaugcacgacagaaccaagaucagacagcugcccaaccugcugagaggcuacgagcacaucagacugagcacccacaacgugaucaacgccgagaaggcccccggcggccccuacaagaucggcaccagcggcagcugccccaacgugaccaacggcaacggcuucuucgccaccauggccugggccgugcccaagaacgacaacaacaagaccgccaccaacagccugaccguggaggugcccuacaucugcaccgagggcgaggaccagaucaccguguggggcuuccacagcgacaacgagacccagauggccaagcuguacggcgacagcaagccccagaaguucaccagcagcgccaacggcgugaccacccacuacgugagccagaucggcggcuuccccaaccaggccgaggacggcggccugccccagagcggcagaaucgugguggacuacauggugcagaagagcggcaagaccggcaccaucaccuaccagagaggcauccugcugccccagaagguguggugcgccagcggcagaagcaaggugaucaagggcagccugccccugaucggcgaggccgacugccugcacgagaaguacggcggccugaacaagagcaagcccuacuacaccggcgagcacgccaaggccaucggcaacugccccaucugggugaagaccccccugaagcuggccaacggcaccaaguacagaccccccgccaagcugcugaaggagagaggcuucuucggcgccaucgccggcuuccuggagggcggcugggagggcaugaucgccggcuggcacggcuacaccagccacggcgcccacggcguggccguggccgccgaccugaagagcacccaggaggccaucaacaagaucaccaagaaccugaacagccugagcgagcuggaggugaagaaccugcagagacugagcggcgccauggacgagcugcacaacgagauccuggagcuggacgagaagguggacgaccugagagccgacaccaucagcagccagaucgagcuggccgugcugcugagcaacgagggcaucaucaacagcgaggacgagcaccugcuggcccuggagagaaagcugaagaagaugcugggccccagcgccguggagaucggcaacggcugcuucgagaccaagcacaagugcaaccagaccugccuggacagaaucgccgccggcaccuucaacgccggcgaguucagccugcccaccuucgacagccugaacaucaccgccgccagccugaacgacgacggccuggacaaccacaccauccugcuguacuacagcaccgccgccagcagccuggccgugacccugaugaucgccaucuucaucguguacauggugagcagagacaacgugagcugcagcaucugccuguga

SEQ ID NO: 179030 - RNA, 1755 nt, Artificial Sequence; identical to SEQ ID NO: 178918
  derived and/or modified sequence opt4 from hemagglutinin__InfluenzaB__ABN59445
